United States Patent 12,747,451 (RNA ENCODING AN ANTIBODY) - sequence listing, part 3

SEQ ID NO: 11052 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtgggtggggtggatgaagcccgtgaccggcgccgtcagctacgcgcggaagttccagggccgcgtgtccttctacatgacccgggagctcgggatggcctacatggacctgcgcaacctgcggttcgacgacaccgccgtgtacttctgcgcccgcaagacggcgggcgacgtcagcggggacaaccggggctacttcttcgacctctgggggcgcggctcccgggtgatcgtgagctcc

SEQ ID NO: 11053 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaaggagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagc

SEQ ID NO: 11054 - RNA, 381 nt, synthetic construct
  misc_feature 1..381: note = derived and/or modified sequence opt1 from anti-HIV-1_HeavyChain
  source 1..381: mol_type = other RNA
caggcccacctggagcagagcggctccggggtgaagaagcccggcgccagcgtccgcgtgtcctgctggagctccgaggacatcttcaagaccgagctcatccactgggtgcggcaggcgccggggcagggcctggagtggatcgggtgggtcaagaccgtgacgggcgccgtgaacttcggcagcctggacttccgccaccggatctccctcacccgcgaccgggacctgttcaccgcccacatggacatccgcgggctgacccagggcgacacggccacctacttctgcgcccggcagaagttcgagagccgctacaccgggggccaggggtggtacttcgacctctggggccggggcacccacatcgtcgtgtccagc

SEQ ID NO: 11055 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtggatgaagaccgtcacgggcgccgtgaacttcggcagcctggacttccggcaccgcatctccctcacccgggaccgcgacctgttcaccgcccacatggacatccgggggctggcccagggcgacaccgccacgtacttctgcgcgcgccagaagttcgagagccggtacaccgggggccaggggtggtacttcgacctctggggccgcggcacccacatcgtggtctccagc

SEQ ID NO: 11056 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtcgtgagctcc

SEQ ID NO: 11057 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctcc

SEQ ID NO: 11058 - RNA, 384 nt, synthetic construct
  misc_feature 1..384: note = derived and/or modified sequence opt1 from anti-HIV-1_HeavyChain
  source 1..384: mol_type = other RNA
agccacacctggaacaaccgcggctccgccatgaagaagcccggggccagcgtgcgggtctcctgctggaccagcgaggacatcttcgacacgaccgagctgatctactgggtgcgccaggcgccgggccaggggctcgagtggatcggctgggtgaagatcgtctccgggaccgtgaacttcgccagcctggacttccggaaccgcatctccctgagccgggaccgcgacctctccaccgcctacatggacatccggggcctgacgcaggacgacaccgccacctacttctgcgcccgccagaagttcgcgagccggtactccggcgaccaggggagctacttcgacctgtggggccgcgggaccctcatcgtggtctccagc

SEQ ID NO: 11059 - RNA, 381 nt, synthetic construct
  misc_feature 1..381: note = derived and/or modified sequence opt1 from anti-HIV-1_HeavyChain
  source 1..381: mol_type = other RNA
cagagccacctggagcagtccggcagcgccatgaagaagcccggggcctccgtgcgcgtcagctgctggacctccgaggacatcttccacaacgagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcacggcctacatggacatccgcggcctgacccaggacgacaccgccacctacttctgcgcccggcagaagttcgcgtcccgctacagcggcgaccaggggtcctacttcgacctctggggccgggggacgctgatcgtggtcagctcc

SEQ ID NO: 11060 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtggatgaagacggtcaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtggtcagctcc

SEQ ID NO: 11061 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcggggaggtcaagaagcccggcgccagcatgaccgtgtcctgcaagaccgcggacgaggacgtgttcgacgccgcctacatgcactgggtccgccaggccccggggcagacgttcgagtggctgggctggatgaagcccgtgaccggggccgtgaactacgcgcggcagttccagggccgcgtcagcttctaccggacccgcgagctcggcatcgcctacatggacctgcgggacctgaagttcgacgacaccgccgtgtacttctgcgcccgcaagacgaagggggacgtgtccggcgacgaccgggggttcttcttcgacctctggggccgcgggacccgggtcatcgtgagctcc

SEQ ID NO: 11062 - RNA, 381 nt, synthetic construct
  misc_feature 1..381: note = derived and/or modified sequence opt1 from anti-HIV-1_HeavyChain
  source 1..381: mol_type = other RNA
caggcccacctggagcagagcggctccggggtgaagaagctcggcgccagcgtccgcgtgtcctgctggaccagcgaggacatcttcgaggacgagctgatccactgggtgcggcaggcgcccgggcagggcctggagtggatcgggtgggtcaagatcgtgtccggcaccgtgaacttcgccagcctcgacttccgcaaccggatctccctgagccgcgaccgggacctgtccacggcctacatggacatccgcggcctcacccaggacgacaccgccacctacttctgcgcccggcagaagttcgcgagccgctactccggggaccagggcagctacttcgacctgtgggggcggggcacgctgatcgtcgtgtccagc

SEQ ID NO: 11063 - RNA, 381 nt, synthetic construct
  misc_feature 1..381: note = derived and/or modified sequence opt1 from anti-HIV-1_HeavyChain
  source 1..381: mol_type = other RNA
cagagccacctggagcagtccggcagcgccatgaagaagcccggggcctccgtgcgcgtcagctgctggacctccgaggacatcctcaaggcggagctgatctactgggtgcggcaggccccgggccgcgggctggagtggatcggctgggtgaagaccgtcagcgggacggtgaacttcggctccagcgacttccggaaccgcatctccctcacccgggaccgcgacctgagcaccgcccacatggacatccggggcctgacccaggacgacacggccacctacttctgcgcccgccagaagttcgagtccctctacagcgacgaccaggggtcctacttcgacctgtggggccgggggaccctgatcatcgtgagctcc

SEQ ID NO: 11064 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaaggtcagctgcaaggcgtccggctacagcttcaccgactactacatccactggctccgccaggtgcaggggcagcggccggagtggatgggctggatccgcccccggaccggggcccgcaaccaggcccggcagttccagccccgcatctccctgacgcgggaccgcgccctgagcaccgcctacctcgacctgaactccctgaccagcgcggactccggcacctacttctgcgcccggcagacgttcaagcccgacttctacttcgccgaccagggctggagcttcaacctctgggggcgcggcgcccacttcatcgtgtccagc

SEQ ID NO: 11065 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcggggaggtcaagaagcccggcgccagcatgaccgtgtcctgcaagaccgcggacgaggacgtgttcgacgccgcctacatgcactgggtccgccaggccccggggcagacgttcgagtggctgggctggatgaagcccgtgaccggggccgtgaactacgcgcggaagttccagggccgcgtcagcttctaccggacccgcgagctcggcatcgcctacatggacctgcgggacctgaagttcgacgacaccgccgtgtacttctgcgcccgcaagacgaagggggacgtgtccggcgacgaccgggggttcttcttcgacctctggggccgcgggacccgggtcatcgtgagctcc

SEQ ID NO: 11066 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgaccggcgccgtgaacttcggcagcctggacttccggcaccgcatctccctcacccgggaccgcgacctgttcaccgcccacatggacatccgggggctgacgcagggcgacaccgccacctacttctgcgcgcgccagaagttcgagagccggtacaccgggggccaggggtggtacttcgacctctggggccgcggcacgcacatcgtcgtgtccagc

SEQ ID NO: 11067 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggcgccggggtgaagaagcccggcgcgtccgtccgcgtgagctgctggtccagcgaggacatcttcgagcggaccgagctcatccactgggtgcgccaggccccggggcagggcctggagtggatcgggtgggtcaagaccgtgacgggcgccgtgaacttcggctccctggacttccggcaccgcatcagcctcacccgggaccgcgacctgttcaccgcccacatggacatccgggggctgacccagggcgacacggccacctacttctgcgcgcgccagaagttcgagtcccggtacaccgggggccaggggtggtacttcgacctctggggccgcggcacccacatcgtcgtgagctcc

SEQ ID NO: 11068 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctgggcgtccgaggacatcttcgacaccaccgagctcatctactgggtgcggcaggccccgggccaggggctggagtggatcggctgggtgaagatcgtcagcgggacggtgaacttcgcctccctggacttccgcaaccggatcagcctctcccgcgaccgggacctgagcaccgcctacatggacatccgcggcctgacccaggacgacaccgccacgtacttctgcgcgcggcagaagttcgcctcccgctacagcggcgaccaggggtcctacttcgacctctggggccgggggaccctgatcgtggtcagctcc

SEQ ID NO: 11069 - RNA, 381 nt, synthetic construct
  misc_feature 1..381: note = derived and/or modified sequence opt1 from anti-HIV-1_HeavyChain
  source 1..381: mol_type = other RNA
cgctgccggctggtgcagagcggcgccgaggtcaagaagcccggggcctccgtgcgcgtgagctgccaggcgtccggctacaccttcagcgcctacggggtcaactgggtgcggcaggccccgggccaggagctcgagtggatcgggtgggtgaagaccgtcacgggcgccgtgaacttcggctcccccaacttccgccaccggatcagcctgacccgcgaccgggacctgttcaccgcccacatggacatccgcgggctcacccagggcgacacggcgacctacttctgcgcccggcagaagttcgagtcccgctacaccgggggccaggggtggtacttcgacctgtggggccggggcacccacatcgtggtcagctcc

SEQ ID NO: 11070 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgtgccaggcgccggggcagggcctggagtggatcgggtgggtcaagaccgtgacgggcgccgtgaacttcggcagcctggacttccgccaccggatctccctcacccgcgaccgggacctgttcaccgcccacatggacatccgcgggctgacccagggcgacacggccacctacttctgcgcccggcagaagttcgagagccgctacaccgggggccaggggtggtacttcgacctctggggccggggcacccacatcgtcgtgtccagc

SEQ ID NO: 11071 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagatcgtgaccggcgccgtgaacttcggcagcctggacttccggcaccgcatctccctcacgcgggaccgcgacctgttcaccgcccacatggacatccgggggctgacccagggcgacaccgccacgtacttctgcgcccgccagaagttcgagagccggtacaccgggggccaggggtggtacttcgacctctggggccgcggcacccacatcgtcgtgtccagc

SEQ ID NO: 11072 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggcctcgaggtgaagaagcccggggcctccgtgcgcgtcagctgctggacctccgaggacatcttcgacaccacggagctgatctactgggtgcggcaggccccgggccaggggctggagtggatcggctgggtgaagatcgtcagcgggaccgtgaacttcgcgtccctcgacttccgcaaccggatcagcctgtcccgcgaccgggacctgagcaccgcccacatggacatccgcggcctcacccaggacgacacggccacctacttctgcgcccggcagaagttcgcctcccgctacagcggcgaccaggggtcctacttcgacctgtggggccgggggaccctgatcatcgtgagctcc

SEQ ID NO: 11073 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctcc

SEQ ID NO: 11074 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgcgtcccgctacagcggggaccagggctcctacttcgacctgtgggggcggggcaccctcatcgtggtgagctcc

SEQ ID NO: 11075 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtggtgagctcc

SEQ ID NO: 11076 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggaccagcgaggacatcttcgagaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgtccaccgcctacatggacatccgggggctcacgcaggacgacaccgccacctacttctgcgcccgccagaagttcgccagccggtactccggcgaccaggggagctacttcgacctgtggggccgcgggaccctgatcgtggtgtccagc

SEQ ID NO: 11077 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgagtcccgctacaccggcgggcagggctggtacttcgacctctgggggcggggcacccacatcgtggtcagctcc

SEQ ID NO: 11078 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggcgccgaggtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgagtcccgctacaccggcgggcagggctggtacttcgacctctgggggcggggcacccacatcgtggtcagctcc

SEQ ID NO: 11079 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccagggcgacacggccacctacttctgcgcccggcagaagttcgagtcccgctacaccgggggccaggggtggtacttcgacctctggggccgggggacccacatcgtggtcagctcc

SEQ ID NO: 11080 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccgacttccggcaccgcatctccctgagccgggaccgcgacctctccaccgcccacatggacatccgggggctgacccaggacgacaccgccacgtacttctgcgcccgccagaagttcgcgagccggtactccggcgaccaggggagctacttcgacctgtggggccgcgggaccctcatcatcgtctccagc

SEQ ID NO: 11081 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcggggcctggagtggatcgggtgggtcaagacggtgtccggcaccgtgaacttcggcagctccgacttccgcaaccgggtcagcctgacccgcgaccgggacctctccaccgcccacatggacatccgcgggctgacgcaggacgacaccgccacctacttctgcgcccggcagaagttcgagagcctgtactccgacgaccagggcagctacttcgacctctgggggcgcggcaccctgatcatcgtgtccagc

SEQ ID NO: 11082 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggaaccgcatcagcctgacccgggaccgcgacctctccaccgcccacatggacatccgggggctgacgcaggacgacaccgccacctacttctgcgcccgccagaagttcgagagcctgtactccgacgaccagggcagctacttcgacctctgggggcggggcaccctgatcatcgtctccagc

SEQ ID NO: 11083 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagcgccccggggcctccgtgcgggtcagctgctggacctccgaggacatcttcgacaccacggagctcatctactgggtgcgccaggcgccgggccaggggctggagtggatcggctgggtgaagatcgtcagcgggaccgtgaacttcgcctccctggacttccggaaccgcatcagcctctcccgggaccgcgacctgagcaccgcctacatggacatccggggcctgacccaggacgacacggccacctacttctgcgcccgccagaagttcgcgtcccggtacagcggcgaccaggggtcctacttcgacctctggggccgcgggaccctgatcgtggtcagctcc

SEQ ID NO: 11084 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggaaccgcatctccctgagccgggaccgcgacctgtccacggcctacatggacatccgggggctcacccaggacgacaccgccacctacttctgcgcgcgccagaagttcgccagccggtactccggcgaccaggggagctacttcgacctgtggggccgcgggacgctgatcgtcgtgtccagc

SEQ ID NO: 11085 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacttcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtcgtgagctcc

SEQ ID NO: 11086 - RNA, 381 nt, synthetic construct
  misc_feature 1..381: note = derived and/or modified sequence opt1 from anti-HIV-1_HeavyChain
  source 1..381: mol_type = other RNA
caggcccacctggagcagagcggctccggggtgaagaagcccggcgccagcgtccgcgtgtcctgctggagctccgaggacatcttccggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagc

SEQ ID NO: 11087 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagtccctgtacagcgacgaccaggggtcctacttcgacctctggggccgggggaccctgatcatcgtgagctcc

SEQ ID NO: 11088 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctcc

SEQ ID NO: 11089 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcccacatggacatccgcggcctgacccaggacgacacggccacctacttctgcgcccggcagaagttcgcgagccgctactccggcgaccaggggagctacttcgacctgtggggccgggggaccctcatcgtggtctccagc

SEQ ID NO: 11090 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatctactgggtgcgccaggcgccggggcggggcctggagtggatcgggtgggtcaagacggtgtccggcaccgtgaacttcggcagctccgacttccgcaaccggatcagcctgacccgcgaccgggacctctccaccgcccacatggacatccgcgggctgacgcaggacgacaccgccacctacttctgcgcccggcagaagttcgagagcctgtactccgacgaccagggcagctacttcgacctctgggggcgcggcaccctgatcatcgtctccagc

SEQ ID NO: 11091 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatccactgggtgcggcaggcgccgggccaggggctggagtggatcggctgggtgaagaccgtcaccggggccgtgaacttcggcagcctggacttccgccaccggatctccctcacccgcgaccgggacctgttcacggcccacatggacatccgcggcctgacccagggggacaccgccacctacttctgcgcccggcagaagttcgagagccgctacacgggcgggcagggctggtacttcgacctctgggggcggggcacccacatcgtggtctccagc

SEQ ID NO: 11092 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcggcaccacggagctcatctactgggtgcggcaggcgccggggcagggcctggagtggatcgggtgggtgaagatcgtcagcggcaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggggaccagggctcctacttcgacctctgggggcggggcaccctgatcgtggtcagctcc

SEQ ID NO: 11093 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggctccgccatgaagaagcccggggccagcgtgcgcgtgtcctgctggaccagcgaggacatcttcgacaccacggagctcatctactgggtccggcaggcgccgggccaggggctggagtggatcggctgggtgaagatcgtgtccgggaccgtcaacttcgccagcctggacttccgcaaccggatctccctcagccgcgaccgggacctgtccaccgcctacatggacatccgcggcctgacccaggacgacacggccacctacttctgcgcccggcagaagttcgcgagccgctactccggcgaccaggggagctacttcgacctctggggccgggggaccctgatcgtggtgtccagc

SEQ ID NO: 11094 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggggatcttcgagcggaccgagctcatccactgggtgcgccaggcgccgggccaggggctggagtggatcggctgggtcaagacggtgaccggcgccgtgaacttcgggtccctggacttccggcaccgcatcagcctcacccgggaccgcgacctgttcaccgcccacatggacatccggggcctgacgcagggggacaccgccacctacttctgcgcccgccagaagttcgagtcccggtacaccggcgggcagggctggtacttcgacctctggggccgcgggacgcacatcgtcgtgagctcc

SEQ ID NO: 11095 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggcgcgccaggccccggggcagggcctggagtggatcgggtgggtgaagacggtcaccggcgccgtgaacttcggctcccccaacttccggcaccgcgccagcctgacccgggaccgcgacctcttcaccgcccacatggacatccgggggctgacggagggcgacaccgcgacctacttctgcgcccgccagaagttcgcctcccggtacagcggggaccagggctcctacttcgacctgtgggggcgcggcaccctcatcatcgtgagctcc

SEQ ID NO: 11096 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccgcggagctcatctactgggtgcggcaggccccgggccaggggctggagtggatcggctgggtgaagatcgtcagcgggacggtgaacttcgcctccctggacttccgcaaccggatcagcctctcccgcgaccgggacctgagcaccgcccacatggacatccgcggcctgcggcaggacgacaccgccacctacttctgcgcgcgccagaagttcgagtcccggtacagcggcgaccaggggtcctacttcgacctctggggccgcgggacgctgatcatcgtgagctcc

SEQ ID NO: 11097 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgagtgggtcaaggccgtgtccggggccgtgaactacggcagcctcgacttccggcaccgcgtctccctgacgcgggaccgcgacctgttcaccgcccacatggacatccggggcctcacccaggacgacaccgccacgtacttctgcgcgcgccagaagttcgagagccggtacaccgggggccaggggtggtacttcgacctgtggggccgcgggacccacatcgtggtgtccagc

SEQ ID NO: 11098 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctggactgcgtgagctcc

SEQ ID NO: 11099 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcggggccgtgaacttcgcctccctggacttccgcaaccggatcagcctctcccgcgaccgggacctgagcaccgcccacatggacatccgcggcctgacccaggacgacaccgccacgtacttctgcgcgcggcagaagttcgcctcccgctacagcggcgaccaggggtcctacttcgacctctggggccgggggaccctgatcatcgtgagctcc

SEQ ID NO: 11100 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccagggcgacaccgccacgtacttctgcgcgcgccagaagttcgagtcccggtacaccgggggccaggggtggtacttcgacctgtggggccgcggcacccacatcgtggtgagctcc

SEQ ID NO: 11101 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctctccaccgcccacatggacatccgcgggctgacccaggacgacacggccacctacttctgcgcccggcagaagttcgagagcctgtactccgacgaccagggcagctacttcgacctctgggggcgcggcaccctgatcatcgtgtccagc

SEQ ID NO: 11102 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcaccgcatcagcctcacccgggaccgcgacctgttcacggcccacatggacatccgggggctgacccagggcgacaccgccacctacttctgcgcccgccagaagttcgagtcccggtacaccgggggccaggggtggtacttcgacctctggggccgcggcacgcacatcgtcgtgagctcc

SEQ ID NO: 11103 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagatcgtcagcgggacggtgaacttcgcctccctggacttccgcaaccggatcagcctctcccgcgaccgggacctgagcaccgcccacatggacatccgcggcctgacccaggacgacaccgccacgtacttctgcgcccggcagaagttcgcgtcccgctacagcggcgaccaggggtcctacttcgacctctggggccgggggaccctgatcatcgtgagctcc

SEQ ID NO: 11104 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcatcgtgagctcc

SEQ ID NO: 11105 - RNA, 384 nt, synthetic construct
  misc_feature 1..384: note = derived and/or modified sequence opt1 from anti-HIV-1_HeavyChain
  source 1..384: mol_type = other RNA
caggcccgcctggagcagagcggctccggggtgaagaagctcggcgccagcgtccgggtgtcctgctggaccagcgaggacatcttcgagcgcaccgagctgatccactgggtgcggcaggcgcccgggcagggcctggagtggatcgggtgggtcaaggccgtgtccggcgccgtgaactacggcagcctcgacttccgcaaccggatctccctgagccgcgaccgggacctgtccacggcctacatggacatccgcgggctcacccaggacgacaccgccacctacttctgcgcgcggcagaagttcgccagccgctactccggcgaccaggggagctacttcgacctgtggggccgggggacgctgatcgtcgtgtccagc

SEQ ID NO: 11106 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccgccatgaagaagcccggggcgagcgtgcgcgtctcctgctggaccagcgaggacatcttcgacaccacggagctcatctactgggtgcggcaggccccgggccaggggctggagtggatcggctgggtgaagatcgtctccgggaccgtgaacttcgccagcctggacttccgcaaccggatctccctcagccgcgaccgggacctgtccaccgcccacatggacatccgcggcctgacccaggacgacacggccacctacttctgcgcgcggcagaagttcgccagccgctactccggcgaccaggggagctacttcgacctctggggccgggggaccctgatcatcgtgtccagc

SEQ ID NO: 11107 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgagcaccgcctacatggacatccgggggctgacccaggacgacacggccacctacttctgcgcccgccagaagttcgcgtcccggtacagcggcgaccaggggtcctacttcgacctctggggccgcgggaccctgatcgtcgtgagctcc

SEQ ID NO: 11108 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgccaacttcggcagcctggacttccggcaccgcatctccctcacccgggaccgcgacctgttcaccgcccacatggacatccgggggctgacccagggcgacacggccacctacttctgcgcgcgccagaagttcgagagccggtacaccgggggccaggggtggtacttcgacctctggggccgcggcacccacatcgtggtctccagc

SEQ ID NO: 11109 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagc

SEQ ID NO: 11110 - RNA, 381 nt, synthetic construct
  misc_feature 1..381: note = derived and/or modified sequence opt1 from anti-HIV-1_HeavyChain
  source 1..381: mol_type = other RNA
cgctgcatctggcggcaggccggcgggggcgtgaagaagcccggggccagcgtcaccctgtcctgcaagaccgcggacgaggacgtgttcgacgccgcctacatgcactgggtgcgccaggccccgggccagacgttcgagtggctcgggtggatgaagcccgtcaccggcgccgtgagctacgcgcggaagttccagggccgcgtgtccttctacatgacccgggggatccgcatggcctacatggacctgcggaacctgcgcttcgacgacaccgccgtctacttctgcgcccggaagacggcgggcgacgtgagcggggacaaccgcggctacttcttcgacctctgggggcggggctcccgcgtgatcgtcagctcc

SEQ ID NO: 11111 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagatcgtcagcgggacggtgaacttcgcctccctggacttccgcaaccggatcagcctctcccgcgaccgggacctgagcaccgcctacatggacatccgcggcctgacccaggacgacaccgccacgtacttctgcgcccggcagaagttcgcgtcccgctacagcggcgaccaggggtcctacttcgacctctggggccgggggaccctgatcgtggtcagctcc

SEQ ID NO: 11112 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgagcggaccgagctcatccactgggtgcgccaggcgccgggccaggggctggagtggatcggctgggtgaagacggtcaccggggccgtgaacttcggcagcctggacttccggcaccgcatctccctcacccgggaccgcgacctgttcaccgcccacatggacatccggggcctgacgcagggggacaccgccacctacttctgcgcccgccagaagttcgagagccggtacaccggcgggcagggctggtacttcgacctctgggggcgcggcacgcacatcgtggtctccagc

SEQ ID NO: 11113 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcgccgcccacatggacatccgcggcctgacccaggacgacaccgccacgtacttctgcgcgcggcagaagttcgcctcccgctacagcggcgaccaggggtcctacttcgacctctggggccgggggaccctgatcatcgtgagctcc

SEQ ID NO: 11114 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgcgagccggtactccggggaccagggcagctacttcgacctgtgggggcgcggcaccctcatcgtggtgtccagc

SEQ ID NO: 11115 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcacccgccagaagttcgagagccggtacaccgggggccaggggtggtacttcgacctctggggccgcggcacgcacatcgtcgtgtccagc

SEQ ID NO: 11116 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggccccgagtggatcgggtgggtcaagaccgtgacgggcgccgtgaacttcggcagcctggacttccggcaccgcatctccctgacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggcacccacatcgtcgtgtccagc

SEQ ID NO: 11117 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggccccctggacttccggcaccgcatcagcctcacccgggaccgcgacctgttcaccgcccacatggacatccgggggctgacccagggcgacacggccacctacttctgcgcccgccagaagttcgagtcccggtacaccgggggccaggggtggtacttcgacctctggggccgcggcacccacatcgtcgtgagctcc

SEQ ID NO: 11118 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggccccgccatgaagaagccgggggccagcgtgcgcgtctcctgctggaccagcgaggacatcttcgagcggaccgagctcatctactgggtgcgccaggcgcccggccgggggctggagtggatcggctgggtgaagacggtctccgggaccgtgaacttcggcagctccgacttccgcaaccggatcagcctgacccgcgaccgggacctctccaccgcccacatggacatccgcggcctgacgcaggacgacaccgccacctacttctgcgcccggcagaagttcgagagcctgtactccgacgaccaggggagctacttcgacctctggggccgcgggaccctgatcatcgtgtccagc

SEQ ID NO: 11119 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccggggcctgagcaccgcccacatggacatccgcggcctgacccaggacgacacggccacctacttctgcgcccggcagaagttcgcgtcccgctacagcggggaccagggctcctacttcgacctctgggggcggggcaccctgatcatcgtgagctcc

SEQ ID NO: 11120 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgcgagccggtactccggggaccagggcagctacttcgacctgtgggggcgcggcaccctcatcatcgtgtccagc

SEQ ID NO: 11121 - RNA, 384 nt, synthetic construct
  misc_feature 1..384: note = derived and/or modified sequence opt1 from anti-HIV-1_HeavyChain
  source 1..384: mol_type = other RNA
cagagccacctggagcactccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctcc

SEQ ID NO: 11122 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagagcctgtactccgacgaccaggggagctacttcgacctctggggccgggggaccctgatcatcgtgtccagc

SEQ ID NO: 11123 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcatctccctgacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggcacccacatcgtcgtgtccagc

SEQ ID NO: 11124 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctggatcaagctggtcagcggggccgtgaacttcggctccgtggacttccgcaaccggatcagcctctcccgcgaccgggacctgagcaccgcccacatggacatccgcggcctgcggcaggacgacacggccacctacttctgcgcgcgccagaagttcgagtcccggtacagcggggaccagggctcctacttcgacctctgggggcgcggcaccctgatcatcgtcagctcc

SEQ ID NO: 11125 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgaagcgccccggggcgagcgtccgggtgtcctgctggaccagcgaggacatcttcgagcgcaccgagctcatctactgggtgcggcaggccccgggccaggggctggagtggatcggctgggtcaagacggtgtccggggccgtgaacttcggcagccaggacttccgcgaccggttctccctgacccgcgaccgggacctcagcaccgcccacatggacatccgcggcctgacccaggacgacacggccacctacttctgcgcgcggcagaagttcgcctcccgctacagcggggaccagggctcctacttcgacctgtgggggcggggcaccctcatcatcgtcagctcc

SEQ ID NO: 11126 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagcctggacttccgccaccggatctccctcacccgcgaccgggacctgttcaccgcccacatggacatccgcgggctgacccagggcgacacggccacctacttctgcgcccggcagaagttcgagagccgctacaccgggggccaggggtggtacttcgacctctggggccggggcacccacatcgtcgtgtccagc

SEQ ID NO: 11127 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccaggacgacacggccacctacttctgcgcccgccagaagttcgagagcctgtactccgacgaccagggcagctacttcgacctctgggggcggggcaccctgatcatcgtgtccagc

SEQ ID NO: 11128 - RNA, 384 nt, synthetic construct
  misc_feature 1..384: note = derived and/or modified sequence opt1 from anti-HIV-1_HeavyChain
  source 1..384: mol_type = other RNA
cagagccacctgaagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctcc

SEQ ID NO: 11129 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgagcaccgcccacatggacatccgggggctgacccaggacgacacggccacctacttctgcgcccgccagaagttcgcgtcccggtacagcggcgaccaggggtcctacttcgacctctggggccgcgggaccctgatcatcgtcagctcc

SEQ ID NO: 11130 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgagagccggtacaccggcgggcagggctggtacttcgacctgtgggggcgcggcacccacatcgtggtgtccagc

SEQ ID NO: 11131 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcaggacgacaccgccacctacttctgcgcccgccagaagttcgagtccctgtacagcgacgaccagggctcctacttcgacctctgggggcggggcaccctgatcatcgtgagctcc

SEQ ID NO: 11132 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcctcgagcggaccgagctgatctactgggtgcgccaggcgccgggccgggggctggagtggatcggctgggtgaagacggtcagcgggaccgtgaacttcggctccagcgacttccgcaaccggatctccctcacccgcgaccgggacctgagcaccgcccacatggacatccgcggcctgacgcaggacgacaccgccacctacttctgcgcccggcagaagttcgagtccctctacagcgacgaccaggggtcctacttcgacctgtggggccgcgggaccctgatcatcgtgagctcc

SEQ ID NO: 11133 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttcgcgtcccggtacagcggggaccagggctcctacttcgacctgtgggggcgcggcaccctcatcgtggtgagctcc

SEQ ID NO: 11134 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcatcagcctgacccgggaccgcgacctcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtcgtgagctcc

SEQ ID NO: 11135 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgacgacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtggtgagctcc

SEQ ID NO: 11136 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcgtggtcagctcc

SEQ ID NO: 11137 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggaaccgcatcagcctgtcccgggaccgcgacctcagcaccgcccacatggacatccgggggctgacccaggacgacacggccacctacttctgcgcccgccagaagttcgcgtcccggtacagcggcgaccaggggtcctacttcgacctgtggggccgcgggaccctcatcatcgtcagctcc

SEQ ID NO: 11138 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgaagcgccccggggcgagcgtccgggtgtcctgctggaccagcgaggacatcttcgagcgcaccgagctcatctactgggtgcggcaggccccgggccaggggctggagtggatcggctgggtcaagacggtgaccggggccgtgaacttcggctccctggacttccgccaccggatcagcctcacccgcgaccgggacctgttcaccgcccacatggacatccgcggcctgacgcagggggacaccgccacctacttctgcgcgcggcagaagttcgagtcccgctacaccggcgggcagggctggtacttcgacctctgggggcggggcacgcacatcgtcgtgagctcc

SEQ ID NO: 11139 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctggatcaagctggtcagcggggccgtgaacttcggctccgtggacttccgcgaccgggtcagcctcacccgcgaccgggacctgttcacggcccacatggacatccgcggcctgacccaggacgacaccgccacctacttctgcgcgcggcagaagttcgcctcccgctacagcggggaccagggctcctacttcgacctctgggggcggggcacgctgatcatcgtgagctcc

SEQ ID NO: 11140 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcaccgtgaacttcgccagcctggacttccggaaccgcatctccctcagccgggaccgcgacctgtccaccgcctacatggacatccggggcctgacccaggacgacacggccacctacttctgcgcccgccagaagttcgcgagccggtactccggggaccagggcagctacttcgacctctgggggcgcggcaccctgatcgtcgtgtccagc

SEQ ID NO: 11141 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcatctccctgagccgggaccgcgacctctccaccgcctacatggacatccgggggctgacccaggacgacaccgccacgtacttctgcgcccgccagaagttcgcgagccggtactccggcgaccaggggagctacttcgacctgtggggccgcgggaccctcatcgtcgtgtccagc

SEQ ID NO: 11142 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctcccccacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggcaccctcatcgtcgtgtccagc

SEQ ID NO: 11143 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgcccaccgcctacatggacatccgcggcctgacccaggacgacacggccacctacttctgcgcccggcagaagttcgcgagccgctactccggcgaccaggggagctacttcgacctctggggccgggggaccctgatcgtggtctccagc

SEQ ID NO: 11144 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgccagcgggaccgtcaacttcgcctccctggacttccgcaaccggatcagcctctcccgcgaccgggacctgagcaccgcccacatggacatccgcggcctgacccaggacgacacggccacctacttctgcgcgcggcagaagttcgcctcccgctacagcggcgaccaggggtcctacttcgacctctggggccgggggaccctgatcgtggtgagctcc

SEQ ID NO: 11145 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagaccgtcaccggggccgtgaacttcggcagcctggacttccgccaccggatctccctcacccgcgaccgggacctgttcacggcccacatggacatccgcggcctgacccagggggacaccgccacctacttctgcgcccggcagaagttcgagagccgctacacgggcgggcagggctggtacttcgacctctgggggcggggcacccacatcgtggtctccagc

SEQ ID NO: 11146 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggcgccgaggtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctcc

SEQ ID NO: 11147 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgccaccggatcagcctcacccgcgaccgggacctgttcaccgcccacatggacatccgcggcctgacgcagggcgacaccgccacctacttctgcgcccggcagaagttcgagtcccgctacaccgggggccaggggtggtacttcgacctctggggccgggggacgcacatcgtggtcagctcc

SEQ ID NO: 11148 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgacgggggccgtgaacttcggcagcctggacttccgccaccggatctccctcacccgcgaccgggacctgttcaccgcccacatggacatccgcggcctgacccagggggacacggccacctacttctgcgcgcggcagaagttcgagagccgctacaccggcgggcagggctggtacttcgacctctgggggcggggcacccacatcgtcgtgtccagc

SEQ ID NO: 11149 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtccctgtacagcgacgaccaggggtcctacttcgacctctggggccgcgggaccctgatcatcgtgagctcc

SEQ ID NO: 11150 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcgtggtcagctcc

SEQ ID NO: 11151 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttcgagagccggtacaccgggggccaggggtggtacttcgacctgtggggccgcggcacccacatcgtggtgtccagc

SEQ ID NO: 11152 - RNA, 381 nt, synthetic construct
  misc_feature 1..381: note = derived and/or modified sequence opt1 from anti-HIV-1_HeavyChain
  source 1..381: mol_type = other RNA
caggcccacctggagcagagcggctccggggtgaagaagcccggcgccagcgtccgcgtgtcctgctggaccagcgaggacatcctccggaagtccgagctgatccactgggtgcgccaggcgccggggcagggcctggagtggatcgggtgggtcaagaccgtgacgggcgccgtgaacttcggccaccagatcagcgaccgggtctccctcacccgcgaccgggacctgagcaccgcccacatggacatccgcgggctgacccaggacgacacggccacctacttctgcgcccggcagaagttcgagtccctctacagcgacgaccagggctcctacttcgacctgtgggggcgcggcaccctgatcatcgtgagctcc

SEQ ID NO: 11153 - RNA, 384 nt, synthetic construct
  misc_feature 1..384: note = derived and/or modified sequence opt1 from anti-HIV-1_HeavyChain
  source 1..384: mol_type = other RNA
cccgcccacctggagcagagcggctccggggtgaagaagccgggcgccagcgtccgcgtgtcctgctgggcgagcgaggacatcttcgagcggaccgagctcatccactgggtgcgccaggcccccgggcagggcctggagtggatcgggtgggtcaagaccgtgacgggcgccgtgaacttcggctccctggacttccggcaccgcatcagcctcacccgggaccgcgacctgttcaccgcccacatggacatccgggggctgacccagggcgacacggccacctacttctgcgcgcgccagaagttcgagtcccggtacaccgggggccaggggtggtacttcgacctctggggccgcggcacccacatcgtcgtgagctcc

SEQ ID NO: 11154 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgagcggggccgtgaacttcggctccacggacttccgcgagcggatcagcctgtcccgcgaccgggacctcagcaccgcctacatggacatccgcggcctgacccaggacgacgccgcgacctacttctgcgcccggcagaagttcgcctcccgctacagcggggaccagggctcctacttcgacctgtgggggcggggcacgctcatcgtcgtgagctcc

SEQ ID NO: 11155 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacctccggcaccgcatctccctgacccgggaccgcgacctgttcaccgcccacatggacatccgggggctcacccagggcgacacggccacctacttctgcgcccgccagaagttcgagagccggtacaccgggggccaggggtggtacttcgacctgtggggccgcggcacccacatcgtcgtgtccagc

SEQ ID NO: 11156 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgctgatcgtcgtgagctcc

SEQ ID NO: 11157 - RNA, 384 nt, synthetic construct
  misc_feature 1..384: note = derived and/or modified sequence opt1 from anti-HIV-1_HeavyChain
  source 1..384: mol_type = other RNA
agccacgacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctcc

SEQ ID NO: 11158 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgacgggcgccgtgaacttcggctccctcgacttccggcaccgcatcagcctgacccgggaccgcgacctgttcaccgcccacatggacatccgggggctcacccagggcgacacggccacctacttctgcgcgcgccagaagttcgagtcccggtacaccgggggccaggggtggtacttcgacctgtggggccgcggcacccacatcgtcgtgagctcc

SEQ ID NO: 11159 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgcgtcccggtacagcggggaccagggctcctacttcgacctgtgggggcgcggcaccctcatcgtggtgagctcc

SEQ ID NO: 11160 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcccacatgggcatccgcggcctgcggcaggacgacaccgccacgtacttctgcgcccgccagaagttcgagagccggtactccggggaccagggcagctacttcgacctgtgggggcgcggcaccctcatcatcgtgtccagc

SEQ ID NO: 11161 - RNA, 384 nt, synthetic construct
  misc_feature 1..384: note = derived and/or modified sequence opt1 from anti-HIV-1_HeavyChain
  source 1..384: mol_type = other RNA
gaggtgcagctggtccagagcggcgccgacgtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctcc

SEQ ID NO: 11162 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcaccaggcgccggggcagggcctggagtggatcgggtgggtcaagaccgtgacgggcgccgtgaacttcggcagcctggacttccgccaccggatctccctcacccgcgaccgggacctgttcaccgcccacatggacatccgcgggctgacccagggcgacacggccacctacttctgcgcccggcagaagttcgagagccgctacaccgggggccaggggtggtacttcgacctctggggccggggcacccacatcgtcgtgtccagc

SEQ ID NO: 11163 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggccctgagcaccgcccacatggacatccgcggcctgacccaggacgacacggccacctacttctgcgcgcggcagaagttcgcctcccgctacagcggcgaccaggggtcctacttcgacctctggggccgggggaccctgatcatcgtgagctcc

SEQ ID NO: 11164 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcgccagcctggacttccggaaccgcatctccctcagccgggaccgcgacctgtccaccgcctacatggacatccggggcctgacccaggacgacaccgccacgtacttctgcgcgcgccagaagttcgccagccggtactccggggaccagggcagctacttcgacctctgggggcgcggcaccctgatcgtcgtgtccagc

SEQ ID NO: 11165 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctggatcaagctggtcagcggggccgtgaacttcgcctccctcgacttccgcaaccggatcagcctgtcccgcgaccgggacctgagcaccgcctacatggacatccgcggcctcacgcaggacgacaccgcgacctacttctgcgcccggcagaagttcgcctcccgctacagcggcgaccaggggtcctacttcgacctgtggggccgggggaccctgatcgtggtcagctcc

SEQ ID NO: 11166 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccaggacgacacggccacctacttctgcgcccgccagaagttcgcgagccggtactccggcgaccaggggagctacttcgacctctggggccgcgggaccctgatcatcgtctccagc

SEQ ID NO: 11167 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctgggctggatcgggtgggtgaagatcgtcagcggcaccgtgaacttcgcctccctggacttccgcagccggatctccctcagccgcgaccgggacctgtccaccgcctacatggacatccgcggcctgacccaggacgacacggccacctacttctgcgcccggcagaagttcgcgagccgctactccggggaccagggcagctacttcgacctctgggggcggggcaccctgatcgtggtctccagc

SEQ ID NO: 11168 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggccaagacggtcaccggcgccgtgaacttcggctccctggacttccggcaccgcatcagcctcacccgggaccgcgacctgttcaccgcccacatggacatccgggggctgacgcagggcgacaccgccacctacttctgcgcgcgccagaagttcgagtcccggtacaccgggggccaggggtggtacttcgacctctggggccgcggcacgcacatcgtggtcagctcc

SEQ ID NO: 11169 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccgccatgaagaagcccggggcgagcgtgcgcgtctcctgctggaccagcgaggacatcttcgagcggaccgagctcatctactgggtgcgccaggccccgggccgggggctggagtggatcggctgggtgaagacggtctccgggaccgtgaacttcggcagctccgacttccgcaaccggatcagcctgacccgcgaccgggacctctccaccgcccacatggacatccgcggcctgacgcaggacgacaccgccacctacttctgcgcccggcagaagttcgagagcctgtactccgacgaccaggggagctacttcgacctctggggccgcgggaccctgatcatcgtgtccagc

SEQ ID NO: 11170 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcggctccctggacttccgccaccggatcagcctcacccgcgaccgggacctgttcaccgcccacatggacatccgcggcctgacgcagggggacaccgccacctacttctgcgcccggcagaagttcgagtcccgctacaccggcgggcagggctggtacttcgacctctgggggcggggcacgcacatcgtggtcagctcc

SEQ ID NO: 11171 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgacaccacggagctgatctactgggtgcggcaggcgcccgggcagggcctggagtggatcgggtgggtcaagatcgtgtccggcaccgtgaacttcgccagcctcgacttccgcaaccggatctccctgagccgcgaccgggacctgtccaccgcctacatggacatccgcggcctcacccaggacgacacggccacctacttctgcgcccggcagaagttcgcgagccgctactccggggaccagggcagctacttcgacctgtgggggcggggcaccctgatcgtcgtgtccagc

SEQ ID NO: 11172 - RNA, 384 nt, synthetic construct
  misc_feature 1..384: note = derived and/or modified sequence opt1 from anti-HIV-1_HeavyChain
  source 1..384: mol_type = other RNA
agccacaacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctcc

SEQ ID NO: 11173 - RNA, 384 nt, synthetic construct
  misc_feature 1..384: note = derived and/or modified sequence opt1 from anti-HIV-1_HeavyChain
  source 1..384: mol_type = other RNA
agccacacctggaacaaccgcggctccgccatgaagaagcccggggccagcgtgcgggtctcctgctggaccagcgaggacatcttcgagcgcacggagctgatctactgggtgcggcaggcgccgggccgcgggctcgagtggatcggctgggtgaagaccgtctccgggaccgtgaacttcggcagctccgacttccggaaccgcatcagcctgtcccgggaccgcgacctgagcaccgcccacatggacatccggggcctcacgcaggacgacaccgccacctacttctgcgcccgccagaagttcgcctcccggtacagcggggaccagggctcctacttcgacctgtgggggcgcggcaccctgatcatcgtgagctcc

SEQ ID NO: 11174 - RNA, 384 nt, synthetic construct
  misc_feature 1..384: note = derived and/or modified sequence opt1 from anti-HIV-1_HeavyChain
  source 1..384: mol_type = other RNA
agccacacctggaacgagtccggcagcgccatgaagaagcccggggcctccgtgcgcgtcagctgctggacctccgaggacatcttcgagcggacggagctgatctactgggtgcgccaggcgccgggccgggggctcgagtggatcggctgggtgaagatcgtcagcgggaccgtgaacttcgcctccctggacttccgcaaccggatcagcctgtcccgcgaccgggacctcagcaccgcctacatggacatccgcggcctgacccaggacgacacggccacctacttctgcgcccggcagaagttcgcgtcccgctacagcggcgaccaggggtcctacttcgacctgtggggccgggggaccctcatcgtggtcagctcc

SEQ ID NO: 11175 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaactacggctccctgaacttccgcagccggatctccctgacccgcgaccgggacctcttcacggcccacatggacatccgcgggctgacccagggcgacaccgccacctacttctgcgcccggcagaagttcgagagccgctacaccgggggccaggggtggtacttcgacctgtggggccggggcacgcacatcgtcgtgtccagc

SEQ ID NO: 11176 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtcaaggtgtcctgctggaccagcgaggacatcttcgagcgcaccgagctcatccactgggtgcggcaggcgccggggcagggcctggagtggatcgggtgggtcaagacggtgaccggcgccgtgaacttcggctccctggacttccgccaccggatcagcctcacccgcgaccgggacctgttcaccgcccacatggacatccgcgggctgacgcagggcgacaccgccacctacttctgcgcccggcagaagttcgagtcccgctacaccgggggccaggggtggtacttcgacctctggggccggggcacgcacatcgtcgtgagctcc

SEQ ID NO: 11177 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcagcaccgcctacatggacatccgcggcctgacccaggacgacacggccacctacttctgcgcgcggcagaagttcgcctcccgctacagcggggaccagggctcctacttcgacctgtgggggcggggcaccctcatcgtggtgagctcc

SEQ ID NO: 11178 - RNA, 384 nt, synthetic construct
  misc_feature 1..384: note = derived and/or modified sequence opt1 from anti-HIV-1_HeavyChain
  source 1..384: mol_type = other RNA
ggccacgacctggagcagagcgggtccggcgtgaagaagcccggggccagcgtccgcgtgtcctgctggaccagcgaggacatcttcgagggctccgagctcatccactgggtgcggcaggccccggggcagggcctggagtggatcggctgggtcaagaccgtgacgggggcggtgaacttcggcagcgcctacttccgccaccggatctccctgagccgcgaccgggacctctccaccgcctacatggacatccgcgggctgacccaggacgacaccgccacgtacttctgcgcccggcagaagttcgcgagccgctactccggcgaccaggggagctacttcgacctgtggggccggggcaccctcatcgtcgtgtccagc

SEQ ID NO: 11179 - RNA, 384 nt, synthetic construct
  misc_feature 1..384: note = derived and/or modified sequence opt1 from anti-HIV-1_HeavyChain
  source 1..384: mol_type = other RNA
agccacacctggaacaaccgcggctccgccatgaagaagcccggggccagcgtgcgggtctcctgctggaccagcgaggacatcttcgacacgaccgagctgatctactgggtgcgccaggcgccgggccaggggctcgagtggatcggctgggtgaagaccgtctccgggaccgtgaacttcggcagctccgacttccggaaccgcatcagcctgacgcgggaccgcgacctgtccaccgcccacatggacatccggggcctcacccaggacgacaccgccacgtacttctgcgcccgccagaagttcgagagcctgtactccgacgaccaggggagctacttcgacctgtggggccgggggaccctcatcatcgtgtccagc

SEQ ID NO: 11180 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgtccggcgcggtgaacttcggcagccccaacttccgccaccgggtctccctgacccgcgaccgggacctgttcaccgcccacatggacatccgcgggctcacgcagggcgacaccgccacctacttctgcgcccggcagaagttcgagagccgctacaccgggggccaggggtggtacttcgacctgtggggccggggcacgcacatcgtggtgtccagc

SEQ ID NO: 11181 - RNA, 384 nt, synthetic construct
  misc_feature 1..384: note = derived and/or modified sequence opt1 from anti-HIV-1_HeavyChain
  source 1..384: mol_type = other RNA
agccacacctggaacaaccgcggctccgccatgaagaagcccggggccagcgtgcgggtctcctgctggaccagcgaggacatcttcgagcgcacggagctgatctactgggtgcggcaggcgccgggccgcgggctcgagtggatcggctgggtgaagaccgtctccgggaccgtgaacttcggcagctccgacttccggaaccgcatcagcctgacccgggaccgcgacctgtccacggcccacatggacatccggggcctcacccaggacgacaccgccacctacttctgcgcccgccagaagttcgagagcctgtactccgacgaccaggggagctacttcgacctgtggggccgggggacgctcatcatcgtgtccagc

SEQ ID NO: 11182 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgcctcgcgtccgaggacatcttcgacaccaccgagctgatctactgggtgcggcaggccccgggccaggggctggagtggatcggctgggtgaagatcgtcagcgggacggtgaacttcgcctccctcgacttccgcaaccggatcagcctgtcccgcgaccgggacctgagcaccgcctacatggacatccgcggcctcacccaggacgacaccgccacgtacttctgcgcgcggcagaagttcgcctcccgctacagcggcgaccaggggtcctacttcgacctgtggggccgggggaccctgatcgtggtcagctcc

SEQ ID NO: 11183 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcgccgccatgaagaagcccggggcgagcgtgcgcgtctcctgctggaccagcgaggacatcttcgacaccacggagctcatctactgggtgcggcaggccccgggccaggggctggagtggatcggctgggtgaagatcgtctccgggaccgtgaacttcgccagcctggacttccgcaaccggatctccctcagccgcgaccgggacctgtccaccgcccacatggacatccgcggcctgcggcaggacgacaccgccacgtacttctgcgcgcgccagaagttcgagagccggtactccggcgaccaggggagctacttcgacctctggggccgcgggaccctgatcatcgtgtccagc

SEQ ID NO: 11184 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggaccagcgaggacatcttcgagaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgttcaccgcccacatggacatccgggggctcacgcagggcgacaccgccacctacttctgcgcccgccagaagttcgagtcccggtacaccgggggccaggggtggtacttcgacctgtggggccgcggcacgcacatcgtggtgagctcc

SEQ ID NO: 11185 - RNA, 384 nt, synthetic construct
  misc_feature 1..384: note = derived and/or modified sequence opt1 from anti-HIV-1_HeavyChain
  source 1..384: mol_type = other RNA
agccacacctggaacgagtccggcagcgccatgaagaagcccggggcctccgtgcgcgtcagctgctggacctccgaggacatcttcgacacgaccgagctgatctactgggtgcggcaggcgccgggccaggggctcgagtggatcggctgggtgaagatcgtcagcgggaccgtgaacttcgcctccctggacttccgcaaccggatcagcctgtcccgcgaccgggacctcagcaccgcctacatggacatccgcggcctgacgcaggacgacaccgccacctacttctgcgcccggcagaagttcgcgtcccgctacagcggcgaccaggggtcctacttcgacctgtggggccgggggaccctcatcgtggtcagctcc

SEQ ID NO: 11186 - RNA, 384 nt, synthetic construct
  misc_feature 1..384: note = derived and/or modified sequence opt1 from anti-HIV-1_HeavyChain
  source 1..384: mol_type = other RNA
cgccacacctggaacgagagcggctccggggtgaagaagcccggcgccagcgtccgggtgtcctgctggagctccgaggacatcttcgagcgcaccgagctgatccactgggtgcggcaggccccggggcgcggcctcgagtggatcgggtgggtcaagacggtgagcggcaccgtgaacttcggctccagcgacttccggaaccgcatctccctgacccgggaccgcgacctgagcaccgcgcacatggacatccgggggctcacgcaggacgacaccgccacctacttctgcgcccgccagaagttcgagtccctgtacagcgacgaccagggctcctacttcgacctgtgggggcggggcaccctcatcatcgtcagctcc

SEQ ID NO: 11187 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgagatgaagaagcccggggcctccgtgcgcgtcagctgctggacctccgaggacatcttcgacaccacggagctcatctactgggtgcggcaggccccgggccaggggctggagtggatcggctgggtgaagatcgtcagcgggaccgtgaacttcgcgtccctggacttccgcaaccggatcagcctctcccgcgaccgggacctgagcaccgcctacatggacatccgcggcctgacccaggacgacacggccacctacttctgcgcccggcagaagttcgcctcccgctacagcggcgaccaggggtcctacttcgacctctggggccgggggaccctgatcgtggtcagctcc

SEQ ID NO: 11188 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcaccgtgaacttcggctccctgaacttccgccagcgggtcagcctgacgcgcgaccgggacctcttcaccgcgcacatggacatccgcgggctgacccagggcgacaccgccacgtacttctgcgcccggcagaagttcgagtccctgtacagcgacgaccaggggtcctacttcgacctctggggccgcgggaccctgatcatcgtgagctcc

SEQ ID NO: 11189 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccagatcttccggcaccgcatctccctgacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggcacccacatcgtcgtgtccagc

SEQ ID NO: 11190 - RNA, 384 nt, synthetic construct
  misc_feature 1..384: note = derived and/or modified sequence opt1 from anti-HIV-1_HeavyChain
  source 1..384: mol_type = other RNA
agccacacctggaacaagtccggcagcgccatgaagaagcccggggcctccgtgcgcgtcagctgctggacctccgaggacatcttcgagcggacggagctgatctactgggtgcgccaggcgccgggccgggggctcgagtggatcggctgggtgaagaccgtcagcgggaccgtgaacttcggctccagcgacttccgcaaccggatctccctgacccgcgaccgggacctgagcacggcccacatggacatccgcggcctcacccaggacgacaccgccacctacttctgcgcccggcagaagttcgagtccctgtacagcgacgaccaggggtcctacttcgacctgtggggccgcgggacgctcatcatcgtgagctcc

SEQ ID NO: 11191 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagccagatcttccggcaccgcatctccctgacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggccccaccctcttcgtctccagc

SEQ ID NO: 11192 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctggatcaagacctgcagcggggccgtcaacttcggctccgtggacttccgcgaccgggtgagcctgacgcgcgaccgggacctcttcaccgcccacatggacatccgcggcctgacccagggggacaccgccacgtacttctgcgcgcggcagaagttcgagtcccgctacaccggcgggcagggctggtacttcgacctgtgggggcggggcacccacatcgtcgtgagctcc

SEQ ID NO: 11193 - RNA, 384 nt, synthetic construct
  misc_feature 1..384: note = derived and/or modified sequence opt1 from anti-HIV-1_HeavyChain
  source 1..384: mol_type = other RNA
agccacaccgtggagcagtccggcagcgccatgaagaagcccggggcctccgtccgcgtgagctgctggacctccgaggacatcttcgacacgaccgagctgatctactgggtgcggcaggcgccgggccaggggctcgagtggatcggctgggtcaagatcgtgagcgggaccgtgaacttcgcctccctggacttccgcaaccggatcagcctgtcccgcgaccgggacctcagcaccgcctacatggacatccgcggcctgacgcaggacgacaccgccacctacttctgcgcccggcagaagttcgcgtcccgctacagcggcgaccaggggtcctacttcgacctgtggggccgggggaccctcatcgtcgtgagctcc

SEQ ID NO: 11194 - RNA, 384 nt, synthetic construct
  misc_feature 1..384: note = derived and/or modified sequence opt1 from anti-HIV-1_HeavyChain
  source 1..384: mol_type = other RNA
cgccacacctggaacaagagcggctccggggtgaagaagcccggcgccagcgtccgggtgtcctgctggagctccgaggacatcttcgagcgcaccgagctgatccactgggtgcggcaggccccggggcagggcctcgagtggatcgggtgggtcaagacggtgaccggcgcggtgaacttcggcagcctggacttccgccaccggatctccctgacccgcgaccgggacctcttcaccgcccacatggacatccgcgggctgacgcagggcgacaccgccacctacttctgcgcccggcagaagttcgagagccgctacaccgggggccaggggtggtacttcgacctgtggggccggggcacgcacatcgtcgtgtccagc

SEQ ID NO: 11195 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagcggctggagtggatcggctgggtcaagacggtgaccggggccgtgaacttcggctcccccaacttccgccaccgggtcagcctgacccgcgaccgggacctctccaccgcctacatggacatccgcggcctgacgcaggacgacaccgccacctacttctgcgcccggcagaagttcgcgagccgctactccggggaccagggcagctacttcgacctgtgggggcggggcaccctcatcgtggtgtccagc

SEQ ID NO: 11196 - RNA, 384 nt, synthetic construct
  misc_feature 1..384: note = derived and/or modified sequence opt1 from anti-HIV-1_HeavyChain
  source 1..384: mol_type = other RNA
agccacgacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctcc

SEQ ID NO: 11197 - RNA, 384 nt, synthetic construct
  misc_feature 1..384: note = derived and/or modified sequence opt1 from anti-HIV-1_HeavyChain
  source 1..384: mol_type = other RNA
cgccacacctggaacgagagcggctccggggtgaagaagcccggcgccagcgtccgggtgtcctgctggagctccgaggacatcttcgagcgcaccgagctgatccactgggtgcggcaggccccggggcagggcctcgagtggatcgggtgggtcaagacggtgaccggcgcggtgaacttcggcagcctggacttccgccaccggatctccctgacccgcgaccgggacctcttcaccgcccacatggacatccgcgggctgacgcagggcgacaccaccacctacttctgcgcccggcagaagttcgagagccgctacaccgggggccaggggtggtacttcgacctgtggggccggggcacgcacatcgtcgtgtccagc

SEQ ID NO: 11198 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcaggtctggagcggcgtgaagaagcccggggcctccgtgcgggtgagctgctggtccagcgaggacatcttcgagcgcaccgagctgatccactgggtccggcaggccccgggccaggggctcgagtggatcggctgggtgaagacggtgaccggggcggtcaacttcggctccctggacttccgccaccggatcagcctgacccgcgaccgggacctcttcaccgcccacatggacatccgcggcctgacgcagggggacaccgccacctacttctgcgcccggcagaagttcgagtcccgctacaccggcgggcagggctggtacttcgacctgtgggggcggggcacgcacatcgtggtgagctcc

SEQ ID NO: 11199 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgaccgtcagctgctggacctccgaggacatcttcgacacgaccgagctcatctactgggtgcgccaggcgccgggccaggggctggagtggatcggctgggtgaagatcgtcagcgggaccgtgaacttcgcctccctggacttccggaaccgcatcagcctctcccgggaccgcgacctgagcaccgcctacatggacatccggggcctgacgcaggacgacaccgccacctacttctgcgcccgccagaagttcgcgtcccggtacagcggcgaccaggggtcctacttcgacctctggggccgcgggaccctgatcgtggtcagctcc

SEQ ID NO: 11200 - RNA, 384 nt, synthetic construct
  misc_feature 1..384: note = derived and/or modified sequence opt1 from anti-HIV-1_HeavyChain
  source 1..384: mol_type = other RNA
cgccacgacctggagcagagcggctccggggtgaagaagcccggcgccagcgtccgggtgtcctgctggagctccgaggacatcttcgagcgcaccgagctcatccactgggtgcggcaggccccggggcagggcctggagtggatcgggtgggtcaagaccgtgacgggcgcggtgaacttcggcagcctggacttccgccaccggatctccctcacccgcgaccgggacctgttcaccgcccacatggacatccgcgggctgacccagggcgacacggccacctacttctgcgcccggcagaagttcgagagccgctacaccgggggccaggggtggtacttcgacctctggggccggggcacccacatcgtcgtgtccagc

SEQ ID NO: 11201 - RNA, 384 nt, synthetic construct
  misc_feature 1..384: note = derived and/or modified sequence opt1 from anti-HIV-1_HeavyChain
  source 1..384: mol_type = other RNA
gtgaccacctggaacaagagcggctccgccatgaagaagcccggggccagcgtccgcgtgtcctgctggacgagcgaggacatcttcgacaccaccgagctgatctactgggtgcggcaggcgccgggccgcgggctcgagtggatcggctgggtcaagaccgtgtccgggacggtgaacttcggcagctccgacttccggaaccgcatcagcctgacccgggaccgcgacctgtccaccgcccacatggacatccggggcctcacccaggacgacacggccacctacttctgcgcccgccagaagttcgagagcctgtactccgacgaccaggggagctacttcgacctgtggggccgggggaccctcatcatcgtctccagc

SEQ ID NO: 11202 - RNA, 384 nt, synthetic construct
  misc_feature 1..384: note = derived and/or modified sequence opt1 from anti-HIV-1_HeavyChain
  source 1..384: mol_type = other RNA
cgccacacctggaacaacaccggcagcggggtgaagaagcccggcgcctccgtccgggtgagctgcctggcctccgaggacatcttcgagcgcacggagctcatccactgggtgcggcaggcgccggggcagggcctggagtggatcgggtgggtcaagaccgtgaccggcgccgtgaacttcggcagcctggacttccgccaccggatctccctcacccgcgaccgggacctgttcacggcccacatggacatccgcgggctgacccagggcgacaccgccacctacttctgcgcccggcagaagttcgagagccgctacaccgggggccaggggtggtacttcgacctctggggccggggcacgcacatcgtcgtgtccagc

SEQ ID NO: 11203 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgcctcgcgtccgaggacatcttcgagcggaccgagctgatctactgggtgcgccaggccccgggccgggggcccgagtggatcggctgggtgaagaccgtcagcgggacggtgaacttcggctccagcgacttccgcaaccggatctccctgacccgcgaccgggacctcagcaccgcccacatggacatccgcggcctgacccaggacgacacggccacctacttctgcgcccggcagaagttcgagtccctgtacagcgacgaccaggggtcctacttcgacctctggggccgcgggaccctgatcatcgtgagctcc

SEQ ID NO: 11204 - RNA, 384 nt, synthetic construct
  misc_feature 1..384: note = derived and/or modified sequence opt1 from anti-HIV-1_HeavyChain
  source 1..384: mol_type = other RNA
cgccacacctggaacaacaccggcagcggggtgaagaagcccggcgcctccgtccgggtgagctgctggacgtccgacgacatcttcgagcgcaccgagctgatccactgggtgcggcaggccccggggcagggcctcgagtggatcgggtgggtcaagaccgtgagcggcaccgtgaacttcgcgtccctggacttccgcaaccggatcagcctgtcccgcgaccgggacctcagcacggcctacatggacatccgcggcctgacccaggacgacaccgccacctacttctgcgcccggcagaagttcgcctcccgctacagcggggaccagggctcctacttcgacctgtgggggcggggcacgctcatcgtcgtgagctcc

SEQ ID NO: 11205 - RNA, 384 nt, synthetic construct
  misc_feature 1..384: note = derived and/or modified sequence opt1 from anti-HIV-1_HeavyChain
  source 1..384: mol_type = other RNA
ggcacccccgggaacaagagcggctccggggtgaagaagccgggcgccagcgtccgcgtgtcctgctggagctccgaggacatcttcgagcggaccgagctgatccactgggtgcgccaggcccccgggcagggcctcgagtggatcggctgggtcaagacggtgaccggggcggtgaacttcggcagcctggacttccggcaccgcatctccctgacccgggaccgcgacctcttcaccgcccacatggacatccgggggctgacgcagggcgacaccgccacctacttctgcgcccgccagaagttcgagagccggtacaccgggggccagggctggtacttcgacctgtgggggcgcggcacgcacatcgtcgtgtccagc

SEQ ID NO: 11206 - RNA, 384 nt, synthetic construct
  misc_feature 1..384: note = derived and/or modified sequence opt1 from anti-HIV-1_HeavyChain
  source 1..384: mol_type = other RNA
ggcacccccgggagcgagtccggcagcggggtgaagcgcccgggcgcctccgtccgggtgagctgctggacctccgaggacatcttcgagacgaccgagctgatccactgggtgcgccaggcccccgggcagggcctcgagtggatcggctgggtcaagaccgtgagcggggcggtgaacttcggctccctgaacttccggcaccgcgtcagcctgacccgggaccgcgacctcttcacggcccacatggacatccgggggctgacccagggcgacaccgccacctacttctgcgcccgccagaagttcgagtcccggtacaccgggggccagggctggtacttcgacctgtgggggcgcggcacgcacatcgtggtgagctcc

SEQ ID NO: 11207 - RNA, 384 nt, synthetic construct
  misc_feature 1..384: note = derived and/or modified sequence opt1 from anti-HIV-1_HeavyChain
  source 1..384: mol_type = other RNA
gtgacccccggcaccaacctggggctccgcatgaagaagccgggcgccagcgtccgggtgtcctgctggacgagcgaggacatcttcgacaccaccgagctgatctactgggtgcgccaggcccccgggcagggcctggagtggatcgggtgggtcaagatcgtgtccggcaccgtgaacttcgcgagcctcgacttccggaaccgcatctccctgagccgggaccgcgacctgtccacggcctacatggacatccggggcctcacccaggacgacaccgccacctacttctgcgcccgccagaagttcgccagccggtactccggggaccagggcagctacttcgacctgtgggggcgcggcacgctgatcgtcgtgtccagc

SEQ ID NO: 11208 - RNA, 384 nt, synthetic construct
  misc_feature 1..384: note = derived and/or modified sequence opt1 from anti-HIV-1_HeavyChain
  source 1..384: mol_type = other RNA
cgccacgacctggagcagagcggcgccggggtgaagaagcccggcgcctccgtccgggtgagctgctggtccagcgaggacatcttcgagcgcaccgagctcatccactgggtgcggcaggcgccggggcagggcctggagtggatcgggtgggtcaagaccgtgacgggcgccgtgaacttcggctccctggacttccgccaccggatcagcctcacccgcgaccgggacctgttcaccgcccacatggacatccgcgggctgacccagggcgacacggccacctacttctgcgcccggcagaagttcgagtcccgctacaccgggggccaggggtggtacttcgacctctggggccggggcacccacatcgtcgtgagctcc

SEQ ID NO: 11209 - RNA, 384 nt, synthetic construct
  misc_feature 1..384: note = derived and/or modified sequence opt1 from anti-HIV-1_HeavyChain
  source 1..384: mol_type = other RNA
caggtgcacctggagcagagcggctccggggtcaagaagcccggcgccagcgtgcgcgtgtcctgctggaccagcgaggacatcttcgagaagtccgagctcatccactgggtccggcaggccccggggcagggcctggagtggatcgggtgggtgaagaccgtgacgggcgcggtcaacttcggcagctccgacttccgccagcgggtgagcctgacccccgaccgcgacctcttcaccgcccacatggacatccgggggctgacccagggcgacacggccacctacttctgcgcccgccagaagttcgagtcccggtacaccgggggccaggggtggtacttcgacctgtggggccgcggcacccacatcgtggtcagctcc

SEQ ID NO: 11210 - RNA, 384 nt, synthetic construct
  misc_feature 1..384: note = derived and/or modified sequence opt1 from anti-HIV-1_HeavyChain
  source 1..384: mol_type = other RNA
ggcaccacctgggagcagagcgggtccggcgtgaagaagcccggggccagcgtccgcgtgtcctgctggacgagcgaggacatcttcgagaagtccgagctgatccactgggtgcggcaggccccgggccaggggctcgagtggatcggctgggtcaagaccgtgaccggcgcggtgaacttcgggagcctggacttccgccaccggatctccctgacccgcgaccgggacctcttcacggcccacatggacatccgcggcctgacccagggggacaccgccacctacttctgcgcccggcagaagttcgagagccgctacacgggcgggcagggctggtacttcgacctgtggggccgggggacccacatcgtcgtgtccagc

SEQ ID NO: 11211 - RNA, 384 nt, synthetic construct
  misc_feature 1..384: note = derived and/or modified sequence opt1 from anti-HIV-1_HeavyChain
  source 1..384: mol_type = other RNA
agccacgacctggagcagtccggcagcgagtggaagaagcccggggcctccgtgcgcgtcagctgctggacctccgaggacatcttcgacaccacggagctcatccactgggtgcggcaggccccgggccaggggctggagtggatcggctgggtgaagaccgtcaccggggcggtgaacttcggcagcctggacttccgccaccggatctccctcacccgcgaccgggacctgttcacggcccacatggacatccgcggcctgacccagggggacaccgccacctacttctgcgcccggcagaagttcgagagccgctacacgggcgggcagggctggtacttcgacctctgggggcggggcacccacatcgtggtctccagc

SEQ ID NO: 11212 - RNA, 384 nt, synthetic construct
  misc_feature 1..384: note = derived and/or modified sequence opt1 from anti-HIV-1_HeavyChain
  source 1..384: mol_type = other RNA
cagagccgccccggcaacaagtccgggagcgccatgaagaagccgggcgcctccgtgcgggtcagctgctggacctccgaggacatcttcgagcgcaccgagctgctctgggtgcggcaggcgcccgggcgcggcctggagtggatcgggtgggtgaagacggtcagcggcaccgtgaacttcggctccagcgacttccggaaccgcatctccctgacccgggaccgcgacctcagcaccgcccacatggacatccgggggctgacgcaggacgacaccgccacctacttctgcgcccgccagaagttcgagtccctgtacagcgacgaccagggctcctacttcgacctctgggggcggggcaccctgatcatcgtgagctcc

SEQ ID NO: 11213 - RNA, 384 nt, synthetic construct
  misc_feature 1..384: note = derived and/or modified sequence opt1 from anti-HIV-1_HeavyChain
  source 1..384: mol_type = other RNA
ggcaccacctggagcaagtccgggagcggcgtgaagaagcccggggcctccgtccgcgtgagctgctggacgtccgaggacatcttcgagcggaccgagctgatctactgggtgcgccaggccccgggccaggggctcgagtggatcggctgggtcaagatcgtgagcggcaccgtgaacttcgcgtccctggacttccggaaccgcatcagcctgtcccgggaccgcgacctcagcaccgcccacatggacatccgggggctgacgcaggacgacaccgccacctacttctgcgcccgccagaagttcgcctcccggtacagcggcgaccaggggtcctacttcgacctgtggggccgcgggaccctcatcatcgtcagctcc

SEQ ID NO: 11214 - RNA, 387 nt, synthetic construct
  misc_feature 1..387: note = derived and/or modified sequence opt1 from anti-HIV-1_HeavyChain
  source 1..387: mol_type = other RNA
caggcccacctggagcagagcggctccggggtgaagaagcccggcgccagcgtccgcgtgtcctgctggaccagcgaggacatcctccggaagaagcgcgtggactccgtcgggtgcgacaccgcgccgggccaggggctggagtggatcggctgggtgaagacggtgaccggcgccgtcaacttcgggagctccgacttccggcagcgcgtgagcctgacccgggaccgcgacctcttcaccgcccacatggacatccggggcctgacgcaggacgacaccgccacctacttctgcgcccgccagaagttcgcgtcccggtacagcggggaccagggctcctacttcgacctgtgggggcgcggcaccctcatcgtggtcagctcc

SEQ ID NO: 11215 - RNA, 387 nt, synthetic construct
  misc_feature 1..387: note = derived and/or modified sequence opt1 from anti-HIV-1_HeavyChain
  source 1..387: mol_type = other RNA
aaggcccacctgggcaacaagagcgggtccggcgtgaagaagcccggggccagcgtccgcgtgtcctgctggagctccgaggacatcttcgagcggaccgagctcatccactgggtgcgccaggcgccgggccaggggctggagtggatcggctgggtcaagaccgtgacgggcgccgtgaacttcgggagcctggacttccggcaccgcatctccctcacccgggaccgcgacctgttcaccgcccacatggacatccggggcctgacccagggggacacggccacctacttctgcgcccgccagaagttcgagagccggtacaccggcgggcagggctggtacttcgacctctggggccgcgggacccacatcgtcgtgtccagc

SEQ ID NO: 11216 - RNA, 384 nt, synthetic construct
  misc_feature 1..384: note = derived and/or modified sequence opt1 from anti-HIV-1_HeavyChain
  source 1..384: mol_type = other RNA
accaccgtgggcacgatcctggggcgcgccatgaagaagcccggcgccagcgtccgggtgtcctgctggaccagcgaggacatcttcgacaccaccgagctcatctactgggtgcgccaggcgccggggcagggcctggagtggatcgggtgggtcaagatcgtgtccggcacggtgaacttcgccagcctggacttccggaaccgcatctccctcagccgggaccgcgacctgtccaccgcctacatggacatccggggcctgacccaggacgacaccgccacgtacttctgcgcccgccagaagttcgcgagccggtactccggggaccagggcagctacttcgacctctgggggcgcggcaccctgatcgtcgtgtccagc

SEQ ID NO: 11217 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgaaggtcagctgctggacctccgaggacatcttcgacaccacggagctcatctactgggtgcgccaggcgccgggccaggggctggagtggatcggctgggtgaagatcgtcagcgggaccgtgaacttcgcctccctggacttccggaaccgcatcagcctctcccgggaccgcgacctgagcaccgcctacatggacatccggggcctgacccaggacgacacggccacctacttctgcgcccgccagaagttcgcgtcccggtacagcggcgaccaggggtcctacttcgacctctggggccgcgggaccctgatcgtggtcagctcc

SEQ ID NO: 11218 - RNA, 387 nt, synthetic construct
  misc_feature 1..387: note = derived and/or modified sequence opt1 from anti-HIV-1_HeavyChain
  source 1..387: mol_type = other RNA
cagagccacctggagcaggtctgggtgtgccagtccaagaagcccggcgccagcgtgcgcgtgtcctgctggaccagcgaggacatcttcgacaccacggagctcatctactgggtccggcaggccccggggcagggcctggagtggatcgggtgggtgaagatcgtgtccggcaccgtcaacttcgcgagcctggacttccgcaaccggatctccctcagccgcgaccgggacctgtccaccgcccacatggacatccgcgggctgacccaggacgacacggccacctacttctgcgcccggcagaagttcgccagccgctactccggcgaccagggcagctacttcgacctctgggggcggggcaccctgatcatcgtgtccagc

SEQ ID NO: 11219 - RNA, 384 nt, synthetic construct
  misc_feature 1..384: note = derived and/or modified sequence opt1 from anti-HIV-1_HeavyChain
  source 1..384: mol_type = other RNA
cgccacaccgtggagcagagcggctccggggtcaagaagcccggcgccagcgtgcgggtgtcctgctggagctccgaggacatcttcgagcgcaccgagctgatccactgggtccggcaggccccggggcagggcctcgagtggatggggtgggtgaagacggtgaccggcgcggtcaacttcggcagcctggacttccgccaccggatctccctgacccgcgaccgggacctcttcaccgcccacatggacatccgcgggctgacgcagggcgacaccgccacctacttctgcgcccggcagaagttcgagagccgctacaccgggggccaggggtggtacttcgacctgtggggccggggcacgcacatcgtggtgtccagc

SEQ ID NO: 11220 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctccgcgcgggaggacatcttcgacaccaccgagctcatctactgggtgcgccaggccccgggccaggggctggagtggatcggctgggtgaagatcgtctgcgggacggtgaacttcgccagcctggacttccggaaccgcatctccctcagccgggaccgcgacctgtccaccgcccacatggacatccggggcctgacccaggacgacaccgccacgtacttctgcgcgcgccagaagttcgccagccggtactccggcgaccaggggagctacttcgacctctggggccgcgggaccctgatcatcgtgtccagc

SEQ ID NO: 11221 - RNA, 387 nt, synthetic construct
  misc_feature 1..387: note = derived and/or modified sequence opt1 from anti-HIV-1_HeavyChain
  source 1..387: mol_type = other RNA
gaggtgcagcgcggcgggcgggtcgtgggccgcgacgtgaagaagcccggggccagcgtccgggtgtcctgctggaccagcgaggacatcttccacaccgagctgatctactgggtgcgccaggccccgggccaggggctcgagtggatcggctgggtcaagatcgtgtccggcacggtgaacttcgcgagcctggacttccggaaccgcatctccctgagccgggaccgcgacctctccaccgcctacatggacatccgggggctgacccaggacgacaccgccacgtacttctgcgcccgccagaagttcgccagccggtactccggcgaccaggggagctacttcgacctgtggggccgcgggaccctcatcgtcgtgtccagc

SEQ ID NO: 11222 - RNA, 384 nt, synthetic construct
  misc_feature 1..384: note = derived and/or modified sequence opt1 from anti-HIV-1_HeavyChain
  source 1..384: mol_type = other RNA
ggcaccacctggaacgagagcgggtccggcgtgaagaagcccggggccagcgtccgcgtgccgtgctggtccagcgaggacatcttcgagcggacggagctgatccaccgcgtgcggcaggcccccggccaggggctcgagtggatcggctgggtcaagaccgtgaccggcgcggtgaacttcgggtcccccaacttccgccaccggatcagcctgacccgcgaccgggacctgttcacggcccacatggacatccgcggcctcacccagggggacaccgccacctacttctgcgcccggcagaagttcgagtcccgctacacgggcgggcagggctggtacttcgacctgtggggccgggggacccacatcgtcgtgagctcc

SEQ ID NO: 11223 - RNA, 384 nt, synthetic construct
  misc_feature 1..384: note = derived and/or modified sequence opt1 from anti-HIV-1_HeavyChain
  source 1..384: mol_type = other RNA
cgcagcaactgggtgcagtccggcgccgacgtcaagaagcccggggccagcgtgaagtccagctgctggacctccgaggacatcttcgacaccacggagctgatctactgggtgcggcaggcgccgggccaggggctcgagtggatcggctgggtcaagatcgtgagcgggaccgtgaacttcgcctccctggacttccgcaaccggatcagcctgtcccgcgaccgggacctcagcaccgcctacatggacatccgcggcctgacccaggacgacacggccacctacttctgcgcccggcagaagttcgcgtcccgctacagcggcgaccaggggtcctacttcgacctgtggggccgggggaccctcatcgtcgtgagctcc

SEQ ID NO: 11224 - RNA, 384 nt, synthetic construct
  misc_feature 1..384: note = derived and/or modified sequence opt1 from anti-HIV-1_HeavyChain
  source 1..384: mol_type = other RNA
cccgtgcagctggtccagagcggcgccgaggtgaagaagccgggggcctccgtgaaggtcagctgctggacctccgaggacatcttcgagcgcaccgagctcatccactgggtgcggcaggcgcccggccaggggctggagtggatcggctgggtgaagacggtcaccggggccgtgaacttcggcagcctggacttccgccaccggatctccctcacccgcgaccgggacctgttcaccgcccacatggacatccgcggcctgacgcagggggacaccgccacctacttctgcgcccggcagaagttcgagagccgctacaccggcgggcagggctggtacttcgacctctgggggcggggcacgcacatcgtggtctccagc

SEQ ID NO: 11225 - RNA, 399 nt, synthetic construct
  misc_feature 1..399: note = derived and/or modified sequence opt1 from anti-HIV-1_HeavyChain
  source 1..399: mol_type = other RNA
cgcgagtacctggagcagagcggcgggggcgtgaagaagctcggggcctccgtccgggtgagctgccgcgcctccgaggacctgttcggcgacgaggcgatctacgacgacgagctgatccactggctccgccaggtgcccgggcagcggccggagtggatgggctggatccggcccaagaccggcgcccgcaaccaggcccggcagttccagccccgcatcaacctgagccgggaccgcgccctgaacaccgcctacctcgacctgtccagcctgacgtccgcggacagcgccacctacttctgcgcccggcagaccttcaagcccgacttctacttcgccgaccaggggtggtccttcaacctctggggccgcggggcgcgggtcatcgtgagctcc

SEQ ID NO: 11226 - RNA, 399 nt, synthetic construct
  misc_feature 1..399: note = derived and/or modified sequence opt1 from anti-HIV-1_HeavyChain
  source 1..399: mol_type = other RNA
caggtgcagctggtccagagcggcaccgaggtgaagaagcccggggcctccctccgcgtgagctgccgggcctccgaggacctgttcggcgacaagatcatctacgacgacgaggtcatccactggctgcgccagctcccggggcagcggcccgagtggatgggctggatccgccccaagagcggggcgcggaaccaggcccgccagttccagccccggatctccctgacccgcgaccgggccctgagcacggcctacctcgacctgaactccctgaccagcgccgactccggcacctacttctgcgcgcgccagaccttcaagccggacttctacttcgccgaccagggctggagcttcaacctctgggggcggggcgcccacttcatcgtgtccagc

SEQ ID NO: 11227 - RNA, 399 nt, synthetic construct
  misc_feature 1..399: note = derived and/or modified sequence opt1 from anti-HIV-1_HeavyChain
  source 1..399: mol_type = other RNA
caggcccacctggagcagagcggctccggggtgaagaagcccggcgccagcgtccgggtgtcctgccgggcgagcgaggacctcttcggggacgagatcatctacgacgacgaggtgatccactggctgcgccaggtcccgggccagcggcccgagtggatggggtggatccgccccaagaccggcgcccggaaccaggcccgccagttccagccccggatctccctgacccgcgaccgggccctcagcacggcctacctggacctgaactccctcaccagcgcggactccggcacctacttctgcgcccgccagaccttcaagccggacttctacttcgccgaccaggggtggagcttcaacctgtggggccgcggggcccacttcatcgtgtccagc

SEQ ID NO: 11228 - RNA, 399 nt, synthetic construct
  misc_feature 1..399: note = derived and/or modified sequence opt1 from anti-HIV-1_HeavyChain
  source 1..399: mol_type = other RNA
ggcaacatctggagcgagtccgggggcggggtgaagaagcccggcgccagcgtccgcgtgtcctgccgggccagcgaggacctgttcggggacgagatcatctacgacgacgaggtgatccactggctccgccaggtcccgggccagcggcccgagtggatgggctggatccgccccaagaacgggggccggaaccaggcgcgccagttccagccccggatctccctgacccgcgaccgggccctgaacaccgcctacctcgacctgaacagcctgacgtccgccgacagcgggacctacttctgcgcccgccagaccttcaagccggacttctacttcgcggaccagggctggtccttcaacctctgggggcggggcgcccgcgtgatcgtgagctcc

SEQ ID NO: 11229 - RNA, 399 nt, synthetic construct
  misc_feature 1..399: note = derived and/or modified sequence opt1 from anti-HIV-1_HeavyChain
  source 1..399: mol_type = other RNA
caggtgcagctggtccagagcggcgccgaggtgaagaagcccggggcctccctccgcgtgccgtgccgggcgagcgaggacctgttcggcgacgagatcatctacgacgacgaggtcatccactggctgcgccaggtgcccgggcagcggcccgagtggatgggctggatccgccccaagaccggggcccggaaccaggcccgccagttccagccgcggatctccctcacccgcgaccgggccctgagcacggcctacctggacctcaactccctgaccagcgcggactccggcacctacttctgcgcccgccagaccttcaagcccgacttctacttcgccgaccagggctggagcttcaacctgtgggggcggggcgcccacttcatcgtgtccagc

SEQ ID NO: 11230 - RNA, 390 nt, synthetic construct
  misc_feature 1..390: note = derived and/or modified sequence opt1 from anti-HIV-1_HeavyChain
  source 1..390: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctccgccagccggtccgcc

SEQ ID NO: 11231 - RNA, 393 nt, synthetic construct
  misc_feature 1..393: note = derived and/or modified sequence opt1 from anti-HIV-1_HeavyChain
  source 1..393: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccacccggagcacc

SEQ ID NO: 11232 - RNA, 414 nt, synthetic construct
  misc_feature 1..414: note = derived and/or modified sequence opt1 from anti-HIV-1_HeavyChain
  source 1..414: mol_type = other RNA
caggtgcagctggtccagagcggcgccgaggtgaagaagcccggggcctccgtgaccgtcagctgcaaggcgtcccgctacaccttcatcaactactacatccactgggtgcggcaggccccgggccaggggctcgagtggatcggctgggtgaagcccgtcagcggggccgtgaacttcggctcccccaacttccgccaccgggtgagcctgacgcgcgaccgggacctgttcaccgcccacatggacatccgcggcctcacccagggggacaccgccacgtacttctgcgcgcggcagaagttcgcccgcggcgaccaggggtggttcttcgacctgtggggccgggggaccctgatcgtcgtgtccagcgcctccaccaagggccccagcgtgttcccgcacgacctccgc

SEQ ID NO: 11233 - RNA, 414 nt, synthetic construct
  misc_feature 1..414: note = derived and/or modified sequence opt1 from anti-HIV-1_HeavyChain
  source 1..414: mol_type = other RNA
caggtgcagctggtccagagcggcgccgaggtgaagaagcccggggcctccgtgaaggtcagctgcaaggcgtccggctacaccatcacccgccactacatgcactgggtgcggcaggccccggggcagggcctcgagtggatcgggtgggtgaagacggtcaccggcgccgtgaacttcggcagccccaacttccgccaccgggtgtccctgacccgcgaccgggacctgttcaccgcccacatggacatccgcgggctcacgcagggcgacaccgccacctacttctgcgcgcggcagaagttcgagcgcgggggccaggggtggtacttcgacctgtggggccggggcaccctgatcgtcgtgagctccgccagcacgaaggggccctccgtgttcccccacgacctccgc

SEQ ID NO: 11234 - RNA, 408 nt, synthetic construct
  misc_feature 1..408: note = derived and/or modified sequence opt1 from anti-HIV-1_HeavyChain
  source 1..408: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagccccaacttccgccaccgggtctccctgacccgcgaccgggacctcttcaccgcccacatggacatccgcgggctgacccagggcgacacggccacctacttctgcgcccggcagaagtactacgccgggggccaggggtggtacttcgacctgtggggccgcggcaccctcatcgtggtgagctccgcgagcaccaaggggccctccgacgacctgcgg

SEQ ID NO: 11235 - RNA, 411 nt, synthetic construct
  misc_feature 1..411: note = derived and/or modified sequence opt1 from anti-HIV-1_HeavyChain
  source 1..411: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctccgccagcaccaaggggccctccgtgtacgacctgcgg

SEQ ID NO: 11236 - RNA, 417 nt, synthetic construct
  misc_feature 1..417: note = derived and/or modified sequence opt1 from anti-HIV-1_HeavyChain
  source 1..417: mol_type = other RNA
caggtgcagctggtccagagcggctccggggtgaagaagcccggcgccagcgtgcgcgtctcctgctggaccagcgaggacatcttcgagcggaccgagctcatccactgggtgcgccaggccccggggcagggcctggagtggatcgggtgggtgaagacggtctccggcgcggtgaacttcggcagccccaacttccggcaccgcgtgtccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtcgtgagctccgccagcaccaaggggccctccgtgttcccccacgacctgcgg

SEQ ID NO: 11237 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagccccaacttccgccaccgggtctccctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgagctccgcgagcaccaaggggccctccgtcttccccacgatctacgtg

SEQ ID NO: 11238 - RNA, 417 nt, synthetic construct
  misc_feature 1..417: note = derived and/or modified sequence opt1 from anti-HIV-1_HeavyChain
  source 1..417: mol_type = other RNA
caggtgcagctggagcagagcggctccggggtcaagaagctcggcgccagcgtgcgcgtgtcctgctggaccagcgaggacatcttcgaggacgagctgatccactgggtccggcaggcccccgggcagggcctggagtggatcgggtgggtgaaggcggtgtccggcgccgtcaactacggcagcctcgacttccgccaccgggtgtccctgacccgcgaccgggacctgttcacggcccacatggacatccgcgggctcacccaggacgacaccgccacctacttctgcgcccggcagaagttcgcgcgcggcgaccaggggtggttcttcgacctgtggggccgggggacgctgatcgtggtcagctccggcctccaccagggccccatcgggctgccgccccgcctgagccgg

SEQ ID NO: 11239 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctccgccagcccccgggcccaccgctccagccccaccatctgcgtg

SEQ ID NO: 11240 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccagcgacttccggcagcgcgtctccctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgagctccgcgagcacgaaggggccctccgtcttcccccacgacctgcgc

SEQ ID NO: 11241 - RNA, 414 nt, synthetic construct
  misc_feature 1..414: note = derived and/or modified sequence opt1 from anti-HIV-1_HeavyChain
  source 1..414: mol_type = other RNA
caggtgcacctggtccagagcggcgccgaggtgaagcgccccggggcctccgtgaaggtcagctgcaaggcgtccggctacaccttcaccgactacttcatccactgggtgcggcaggccccggggcagggcctcgagtggatcgggtgggtgaagacggtcagcggcgccgtgaacttcggctccctgaacttccgccaccgggtgagcctgacccgcgaccgggacctcttcaccgcccacatggacatccgcgggctgacccagggcgacacggccacctacttctgcgcgcggcagaagttcgcccgcggggaccagggctggttcttcgacctgtgggggcggggcaccctcatcgtcgtgtccagcgcctccaccaagggccccagcgtgttcccccacgacctgcgc

SEQ ID NO: 11242 - RNA, 420 nt, synthetic construct
  misc_feature 1..420: note = derived and/or modified sequence opt1 from anti-HIV-1_HeavyChain
  source 1..420: mol_type = other RNA
caggtgcagctggtccagagcggcgccgaggtgaagaagcccggggcctccgtgaaggtcagctgcaaggcgtccggctacatcttcaccgggagctacatgcactgggtgcgccaggccccgggccagaccttcgagtggctcgggtggatgaagcccgtgacgggcgccgtcaactacgcccggcagttccagggccgcgtgtccttctaccggacccgcgagctggggatcgcctacatggacctgcgggacctcaagttcgacgacaccgcggtgtacttctgcgcccgcaagaccaagggcgacgtcagcggggacgaccggggcttcttcttcgacctgtgggggcgcggcacgcgggtgatcgtgtccagcgcctccaccaagggccccagcgtcttcccccacgacctgcgc

SEQ ID NO: 11243 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagccccaacttccgccaccgggtctccctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgagctccgcgagcaccaaggggccctccgtcttcccccacgacctgcgc

SEQ ID NO: 11244 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagccccaacttccgccaccgggtctccctgacccgcgaccgggacctcttcaccgcccacatggacatccgcggcctgacccagggggacacggccacctacttctgcgcccggcagaagttcgagcgcggcgggcagggctggtacttcgacctgtggggccgggggaccctcatcgtggtgagctccgcgagcaccaagggcccctccgtcttcccccacgacctgcgc

SEQ ID NO: 11245 - RNA, 420 nt, synthetic construct
  misc_feature 1..420: note = derived and/or modified sequence opt1 from anti-HIV-1_HeavyChain
  source 1..420: mol_type = other RNA
caggtgcagctggtccagagcggcgccgaggtgaagaagcccggggcctccgtgaaggtcagctgcaaggcgtccggctacaccttcaccgggtactacatccactgggtgcgccaggccccgggccaggggctcgagtggatgggctggatcaaccccaacagcggcgccacgaactacgcccagaagttccaggggcggctgaccatcgcccgcgacacctccatcagcaccgcgtacatggacctgcggaacctccgcttcgacgacacggccgtgtacttctgcgcccggaagaccgccggcgacgtctccggggacaaccgcggctacttcttcgacctgtgggggcggggcagccgcgtgatcgtgtccagcgcgtccaccaagggccccagcgtcttcccccacgacctgcgg

SEQ ID NO: 11246 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttccacgacctgcgg

SEQ ID NO: 11247 - RNA, 414 nt, synthetic construct
  misc_feature 1..414: note = derived and/or modified sequence opt1 from anti-HIV-1_HeavyChain
  source 1..414: mol_type = other RNA
caggccaccctggagcagagcggctccggggtgaagaagcccggcgccagcgtccgcgtgtcctgctggagctccgaggacatcttcaagaccgagctcatccactgggtgcggcaggcgccggggcagggcctggagtggatcgggtgggtcaaggccgtgagcggcgccgtgaactacggctccctggacttccgccaccgggtcagcctcacgcgcgaccgggacctgtccaccgcccacatggacatccgcgggctgacccaggacgacaccgccacgcacttctgcgcgcggcagaagttcgcccgcggcgaccaggggtggttcttcgacctctggggccgggggaccctgatcgtggtgagctccgccagcaccaagggcccctccgtcttccccaccatctacgtg

SEQ ID NO: 11248 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttccccaccatctgcgtg

SEQ ID NO: 11249 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggatcttcgacctgtggggccggggcaccctcatcgcggtgagctccgccagcccccgggcccaccgctccagcccccggtccgcc

SEQ ID NO: 11250 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggatcttcgacctgtggggccggggcaccctcatcgcggtgtccagcgcctccaccaaggggcccagcgtgttccccacgatctgcgtc

SEQ ID NO: 11251 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggccccggggtgaagaagctcggcgcctccgtccgcgtgagctgctggacctccgaggacatcttcgagcggaccgagctgatccactgggtgcgccaggcgccggggcagggcctggagtggatcgggtgggtcaaggccgtgagcggcgccgtgaactacggctccctcgacttccggcaccgcgtcagcctgacgcgggaccgcgacctgttcaccgcccacatggacatccgggggctcacccaggacgacaccgccatctacttctgcgcgcgccagaagttcgcccggggcgaccaggggtggttcttcgacctgtggggccgcgggacgctgatcgtggtgtccagcgcctccaccaaggcccaccggagcagcccccgctccacc

SEQ ID NO: 11252 - RNA, 420 nt, synthetic construct
  misc_feature 1..420: note = derived and/or modified sequence opt1 from anti-HIV-1_HeavyChain
  source 1..420: mol_type = other RNA
caggtgcagctggtccagagcggcgccgagatgaagaagcccggggcctccgtgaagctcagctgcatgacctccggctacgtgttcaccgacttctacatccactgggtccgccaggcgccggggcagggcctggagtggatggggtggatcaaccccggcacgggcgggaccatcagcgcgccccggttcctgggccgcgtgaccctcacccgggacacgtccatcagcgccgcctacatcgagatcaaccgcgtgaccatcgacgacaccgccacctacttctgcgcccggcagaagttcgcctcccgctacagcggggaccagggctcctacttcgacctgtgggggcggggcacgctgatcgtcgtgagctccgccagcaccaagggccccctcgggctgccgccccgctccgcc

SEQ ID NO: 11253 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccccggaggacatcttcgagcggaccgagctcatccactgggtgcgccaggcgcccgggcagggcctggagtggatcgggtgggtcaagatcgtgagcggcgccgtgaacttcggctcccccaacttccggcagcgcgtcagcctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgtccagcgccagcccccgggcccaccgctcctccccgcggagcgcc

SEQ ID NO: 11254 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagcccgtgacgggcgccgtgaacctggcccccaacttccggcaccgcgtctccctcacccgggaccgcgacctgttcaccgcccacatggacatccggggcctgacccagggggacacggccacctacttctgcgcgcgccagaagttcgagcggggcgggcagggctggtacttcgacctctgggggcgcggcaccctgatcgtggtgagctccgccagcaccaagggcccctccgtcttcccgcacgacctgcgg

SEQ ID NO: 11255 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaaggccgtgagcggcgccgtgaactacggctccctggacttccggcaccgcgtcagcctcacccgggaccgcgacctgtccacggcccacatggacatccgggggctgacccaggacgacaccgccacctacttctgcgcgcgccagaagttcgcccggggcgaccaggggtggttcttcgacctctggggccgcgggacgctgatcgtggtgagctccgccagcaccaagggcccctccgtcttcccccacgacctgcgg

SEQ ID NO: 11256 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcagcgcgtctccctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgagctccgcgagcaccaaggcccaccgctccagcccccggtccacg

SEQ ID NO: 11257 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttccccacgatctgcgtg

SEQ ID NO: 11258 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagctcggcgccagcgtccgcgtgtcctgctggaccagcgaggacatcttcaagaccgagctgatccactgggtgcggcaggcgcccgggcagggcctggagtggatcgggtgggtcaaggccgtgtccggcgccgtgaactacggcagcctcgacttccgccaccgggtctccctgacgcgcgaccgggacctgagcaccgcccacatggacatccgcgggctcacccaggacgacaccgccacgtacttctgcgcgcggcagaagttcgcccgcggcgaccaggggtggttcttcgacctgtggggccgggggaccctgatcgtggtgtccagcgcctccaccaagggcccgagcgtcttcccccacgacctccgc

SEQ ID NO: 11259 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttccccacgatctacgtg

SEQ ID NO: 11260 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgcccgcggggaccagggctggttcttcgacctgtgggggcggggcacgctcatcgtggtgtccagcgcgtccaccaagggccccagcgtcttccccaccatctgcgtg

SEQ ID NO: 11261 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttcccccagatctacgtg

SEQ ID NO: 11262 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcagaccccggggcagggcctggagtggatcgggtgggtcaagacggtgaccggcgcggtgaacttcggcagctccgacttccgccagcgggtcagcctgacccgcgaccgggacctcttcaccgcccacatggacatccgcgggctgacgcagggcgacaccgccacctacttctgcgcccggcagaagttctacgccgggggccaggggtggtacttcgacctgtggggccgcggcaccctcatcgtggtgtccagcgcgtccacgaaggggcccagcgtcttccccaccatctacgtg

SEQ ID NO: 11263 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggggatccggggcctgacccagggggacaccgccacgtacttctgcgcccgccagaagttcgagcggggcgggcagggctggatcttcgacctgtggggccgcgggaccctcatcgcggtgagctccgccagcaccaagggcccctccgtgttccccaccatctacgtc

SEQ ID NO: 11264 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccgtcttcccccacgacctccgg

SEQ ID NO: 11265 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggatcttcgacctgtggggccggggcaccctcatcgcggtgtccagcgcctccacgaaggggcccagcgtgttcccccggtccgccgtc

SEQ ID NO: 11266 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtggatgaagatcgtctccggcgccgtgaacttcggcagccccaacttccggcagcgcgtgtccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtcagctccgccagcaccaaggggccctccgtgttcccccacgacctgcgg

SEQ ID NO: 11267 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatctccgaggggagcgagctcatccactgggtgcggcaggcgccgggccaggggctggagtggatcggctgggtcaagaccgtgacgggcgccgtgaacttcgggtccgcctacttccgccaccgggtcagcctgacccgcgaccgggacctcttcaccgcccacatggacatccgcggcctgacccagggggacacggccacctacttctgcgcgcggcagaagttctacaagggcgggcagggctggtacttcgacctgtggggccgcgggaccctcatcgtggtgtccagcgcctccaccaagggccccagcgtcttccccacgatctgcgtg

SEQ ID NO: 11268 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaactacggctccctggacttccggcaccgcgtcagcctcacccgggaccgcgacctgtccaccgcccacatggacatccgggggctgacgcaggacgacaccgccacctacttctgcgcccgccagaagttcgcgcggggcgaccaggggtggttcttcgacctctggggccgcgggaccctgatcgtggtgagctccgccagcacgaagggcccctccgtcttcccccacgacctgcgg

SEQ ID NO: 11269 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagatcgtgagcggcgccgtgaacttcggctcccccaacttccggcagcgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgcggtgtccagcgcctccaccaaggggcccagcgtgttccccaccatctacgtc

SEQ ID NO: 11270 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgtccggcgccgtgaacttcggcagcctgaacttccggcaccgcgtctccctcacccgggaccgcgacctgttcaccgcccacatggacatccgggggctgacgcagggcgacaccgccacctacttctgcgcccgccagaagttcgcgcgcggggaccagggctggttcttcgacctctgggggcggggcaccctgatcgtggtgagctccgccagcacgaagggcccctccgtcttccccaccatctgcgtg

SEQ ID NO: 11271 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacctgggctcccccaacttccggcaccgcgtcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtggtgtccagcgcgtccacgaaggggcccagcgtcttcccccacgacctgcgg

SEQ ID NO: 11272 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgagcggggcgggcagggctggatcttcgacctgtgggggcgcggcaccctgatcgccgtgtccagcgcctccaccaagggcccgagcgtgttccccaccatctgcgtc

SEQ ID NO: 11273 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttcccccacgacctggtg

SEQ ID NO: 11274 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaaggccgtgagcggcgccgtgaactacggctccctggacttccggcaccgcgtcagcctcacccgggaccgcgacctgttcacggcccacatggacatccgggggctgacccaggacgacaccgccacctacttctgcgcgcgccagaagttcgcccggggcgaccaggggtggttcttcgacctctggggccgcgggacgctgatcgtggtgtccagcgcctccaccaagggccccagcgtcttccccaccatctacgtg

SEQ ID NO: 11275 - RNA, 420 nt, synthetic construct
  misc_feature 1..420: note = derived and/or modified sequence opt1 from anti-HIV-1_HeavyChain
  source 1..420: mol_type = other RNA
caggtgcacctggagcagagcggctccggggtcaagaagcccggcgcccccgtgcgcgtgagctgctggtccagcgaggacatcttcgagcggaccgagctcatccactgggtccgccaggcccccgggcagggcctggagtggatcgggtgggtgaagaccgtgacgggcgcggtcaacttcggctccctggacttccggcaccgcatcagcctcacccgggaccgcgacctgttcaccgcccacatggacatccgggggctgacccagggcgacacggccacctacttctgcgcccgccagaagttctacgccgggggccaggggtggtacttcgacctctggggccggggcaccctgatcgtggtgtccagcgcgtccaccaaggcccacagcgtcctgccgccccgctcccgggtg

SEQ ID NO: 11276 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccctcgtccgcgtgagctgctggacctccgaggacatcttcgagaagtccgagctgatccactgggtgcggcaggcgccggggcagggcctggagtggatcgggtgggtcaagaccgtgacgggcgccgtgaacttcggcagcagcgacttccgccagcgggtctccctcacccgcgaccgggacctgttcaccgcccacatggacatccgcgggctgacccagggcgacacggccacctacttctgcgcccggcagaagttctacgccgggggccaggggtggtacttcgacctctggggccgcggcaccctgatcgtggtgagctccgcgagcaccaaggggccctccgtcttcccccacgacctgcgg

SEQ ID NO: 11277 - RNA, 414 nt, synthetic construct
  misc_feature 1..414: note = derived and/or modified sequence opt1 from anti-HIV-1_HeavyChain
  source 1..414: mol_type = other RNA
caggtgcagctggtccagagcggcgccgaggtgaagaagcccggggcctccgtgaaggtcagctgccaggtgtccggctacaccctcaccgagctgagcatgcactgggtgcgccaggcgccggggcagggcctggagtggatcgggtgggtcaagacggtgaccggcgccgtgaacttcggctcccccaacttccggcaccgcgtcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtggtgtccagcgcgtccacgaaggggcccagcgtcttcccccacgacctgcgg

SEQ ID NO: 11278 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcaagaccgagctcatccactgggtgcggcaggcgccggggcagggcctggagtggatcgggtgggtcaagatcgtgtccggcgccgtgaacttcggcagccccaacttccgccagcgggtctccctgacgcgcgaccgggacctcttcaccgcccacatggacatccgcgggctgacccagggcgacaccgccacgtacttctgcgcccggcagaagttcgagcgcgggggccaggggtggatcttcgacctgtggggccggggcaccctcatcgcggtgagctccgccagcaccaaggggccctccgtgttcccccacgacctgcgc

SEQ ID NO: 11279 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccgtcttccccaccatctgcgtg

SEQ ID NO: 11280 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtgggtcgggtgggtgaagaccgtgacgggcgccgtcaacttcggcagctccgacttccgccagcgggtgagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtctccagcgcgtccaccaaggggcccagcgtgttcccccacgacctgcgg

SEQ ID NO: 11281 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgtccagcgcgtccaccaaggggcccagcgtcttccccacgatctgcgtg

SEQ ID NO: 11282 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggcccgagcgtcttcccccagatctgcgtg

SEQ ID NO: 11283 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggccaccagatcagcgaccgcgtctccctgacccccgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgagctccgcgagcaccaaggggccctccgtcttccccacgatctgcgtg

SEQ ID NO: 11284 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcgcgcgccggggcagggcctggagtggatcgggtgggtcaagaccgtgacgggcgccgtgaacttcggcagctccgacttccggcagcgcgtcagcctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgtccagcgcgtccaccaaggcccaccgcagctcccccacgatctgcgtc

SEQ ID NO: 11285 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccccgaccaagggccccagcgtcttccccaccatctgcgtg

SEQ ID NO: 11286 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccagcgacttccggcagcgcgtctccctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgagctccgcgagcacgaaggggccctccgtcttcccccagatctacgtg

SEQ ID NO: 11287 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgggcgggacctcttcaccgcccacatggacatccgcggcctgacccagggggacacggccacctacttctgcgcccggcagaagttctacgcgggcgggcagggctggtacttcgacctgtggggccgcgggaccctcatcgtggtgtccagcgcctccaccaagggccccagcgtcttccccacgatctgcgtg

SEQ ID NO: 11288 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctctccaccgcccacatggacatccgggggctgacgcaggacgacaccgccacctacttctgcgcccgccagaagttcgcgcggggcgaccaggggtggttcttcgacctgtggggccgcgggaccctcatcgtggtgagctccgccagcacgaagggcccctccgtcttcccccacgaccacgtg

SEQ ID NO: 11289 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgtccagcgcgtccacgaaggggcccagcgtcttcccccagatctgcgtg

SEQ ID NO: 11290 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgtggtgagctccgcgagcaccaaggggccctccgtcttccccaccatctgcgtg

SEQ ID NO: 11291 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctgggcgagcgaggacatcttcgagcggaccgagctcatccactgggtgcgccaggccccggggcagggcctggagtggatcgggtgggtcaagaccgtgacgggcgccgtgaacttcggctcccccaacttccggcaccgcgtcagcctgacccgggaccgcgacctcttcaccgcccacatggacatccgggggctgacccagggcgacacggccacctacttctgcgcgcgccagaagttctacgccgggggccaggggtggtacttcgacctgtggggccggggcaccctcatcgtggtgtccagcgcctccaccaaggggcccagcgtcttcccccacgacctgctg

SEQ ID NO: 11292 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggatcttcgacctgtggggccggggcaccctcatcgcggtgtccagcgcctccaccaaggggcccagcgtgttcccccacgacctgcgc

SEQ ID NO: 11293 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccgtgtccggcgccgtgaactacggcagcctggacttccggcaccgcgtctccctcacgcgggaccgcgacctgagcaccgcccacatggacatccgggggctgacccaggacgacaccgccacgtacttctgcgcgcgccagaagttcgcccggggcgaccaggggtggttcttcgacctctggggccgcgggaccctgatcgtggtgtccagcgcctccaccaagggccccagcgtcttcccccacgacctgcgg

SEQ ID NO: 11294 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatcgtggtgagctccgcgagcaccaaggggccctccgtcttccccacgatctgccgc

SEQ ID NO: 11295 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgtccagcgcgtccaccaaggggcccagcgtcttcccccacgacctgcgc

SEQ ID NO: 11296 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccgtcttccccaccatctacgtg

SEQ ID NO: 11297 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacaagggcgggcaggggtggtacttcgacctgtggggccgcggcaccctcatcgtggtgtccagcgcgtccaccaaggggcccagcgtcttcccccacgacctgcgg

SEQ ID NO: 11298 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccaggacgacaccgccacctacttctgcgcccgccagaagttcgcccggggcgaccaggggtggttcttcgacctctggggccgcgggacgctgatcgtggtgtccagcgcgtccaccaagggccccagcgtcttcccccacgacctgcgg

SEQ ID NO: 11299 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggccgagcgaggacatcttcgagaagtccgagctcatccactgggtgcggcaggcgcccgggcagggcctggagtggatcgggtgggtcaagaccgtgaccggcgccgtgaacttcggcagctccgacttccgccagcgggtcagcctgacgcgcgaccgggacctcttcaccgcccacatggacatccgcgggctgacccagggcgacaccgccacgtacttctgcgcccggcagaagttcgagcgcgggggccaggggtggatcttcgacctgtggggccggggcaccctcatcgcggtgtccagcgcctccaccaaggggcccagcgtgttcccccacgacctgcgc

SEQ ID NO: 11300 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgtccggcgccgtgaacttcggcagcctgaacttccggcaccgcgtctccctcacccgggaccgcgacctgttcaccgcccacatggacatccgggggctgacgcagggcgacaccgccacctacttctgcgcccgccagaagttcgcgcgcggggaccagggctggttcttcgacctctgggggcggggcaccctgatcgtggtgagctccgccagcacgaagggcccctccgtcttcccccacgacctgcgg

SEQ ID NO: 11301 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtggagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatcgtggtgagctccgcgagcaccaaggggccctccgtcttcccccacgacctgcgc

SEQ ID NO: 11302 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctccgccagcaccaaggggccctccgtgttcccccacgacctgcgg

SEQ ID NO: 11303 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcaacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttcccccacgacctgcgg

SEQ ID NO: 11304 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttctacgccgggggccaggggtggtacttcgacctgtggggccggggcaccctcatcgtggtgagctccgcgagcaccaaggggccctccgtcttcccccacgacctgcgc

SEQ ID NO: 11305 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaactacggctccctgaacttccggagccgcatctccctcacccgggaccgcgacctgttcaccgcccacatggacatccgggggctgacgcagggcgacaccgccacctacttctgcgcccgccagaagttcgagcgcgggggccaggggtggatcttcgacctctggggccggggcaccctgatcgcggtcagctccgccagcacgaaggggccctccgtgttcccccacgacctgcgg

SEQ ID NO: 11306 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccagggcgacacggccacctacttctgcgcccggcagaagttctacgccgggggccaggggtggtacttcgacctctggggccgcgggaccctgatcgtggtctccagcgcgtccaccaagggccccagcgtgttcccccacgacctgcgg

SEQ ID NO: 11307 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggatcgagctcatccactgggtgcgccaggcgccggggcagggcctggagtggatcgggtgggtcaagaccgtgacgggcgccgtgaacttcggctcccccaacttccggcaccgcgtcagcctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgtccagcgcgtccaccaaggggcccagcgtcttcccccacgacctgcgg

SEQ ID NO: 11308 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcagcgcgtctccctgacgcgggaccgcgacctgttcaccgcccacatggacatccgggggctcacccagggcgacaccgccacgtacttctgcgcgcgccagaagttctacgccgggggccaggggtggtacttcgacctgtggggccggggcaccctgatcgtggtgagctccgccagcaccaaggggccgtccgtcttcccccacgacctccgc

SEQ ID NO: 11309 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcgggcggagctcatccactgggtgcgccaggccccggggcagggcctggagtggatcgggtgggtcaagaccgtgaccggcgccgtgaacttcggcagccccaacttccggcagcgcgtctccctgacgcgggaccgcgacctcttcaccgcccacatggacatccgggggctgacccagggcgacaccgccacgtacttctgcgcgcgccagaagttcgagcgcgggggccaggggtggatcttcgacctgtggggccggggcaccctcatcgccgtgagctccgccagcaccaaggggccctccgtgttcccccacgacctgcgg

SEQ ID NO: 11310 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccgtgtccggcgccgtgaactacggcagcctggacttccggcaccgcgtctccctcacgcgggaccgcgacctgttcaccgcccacatggacatccgggggctgacccaggacgacaccgccacgtacttctgcgcgcgccagaagttcgcccggggcgaccaggggtggttcttcgacctctggggccgcgggaccctgatcgtggtgagctccgccagcaccaagggcccctccgtcttcccccacgacctgcgg

SEQ ID NO: 11311 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgagcgcggcgggcagggctggtacttcgacctctgggggcggggcaccctgatcgtggtctccagcgcgtccaccaaggggcccagcgtgttcccccacgacctgcgc

SEQ ID NO: 11312 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttctacgccgggggccaggggtggtacttcgacctctggggccggggcaccctgatcgtcgtgagctccgcgagcaccaaggggccctccgtgttcccccacgacctgcgc

SEQ ID NO: 11313 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccaggacgacacggccatctacttctgcgcccggcagaagttcgcgcgcggcgaccaggggtggttcttcgacctgtggggccgggggaccctcatcgtggtgtccagcgcctccaccaagggccccagcgtcttcccccacgacctgcgc

SEQ ID NO: 11314 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagggccccggggccagcgtccgcgtgtcctgctggaccagcgaggacatcttcgagaccacggagctcatccactgggtgcggcaggcgccgggccaggggctggagtggatcggctgggtcaagaccgtgtccggcgccgtgaacttcgggagcctgaacttccgccaccgggtctccctcacccgcgaccgggacctgttcaccgcccacatggacatccgcggcctgacgcagggggacaccgccacctacttctgcgcccggcagaagttcgcgcgcggcgaccaggggtggttcttcgacctctggggccggggcaccctgatcgtggtgagctccgccagcacgaaggggccctccgtcttcccccacgacctgcgc

SEQ ID NO: 11315 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtccccctgacccgcgaccgggacctcttcaccgcccacatggacatccgcggcctgacccagggggacacggccacctacttctgcgcgcggcagaagttctacaagggcgggcagggctggtacttcgacctgtggggccgcgggaccctcatcgtggtgtccagcgcctccaccaagggccccagcgtcttcccccacgacctgcgg

SEQ ID NO: 11316 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttcccccacgacctgcgg

SEQ ID NO: 11317 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaaggccgtgtccggcgccgtcaactacggcagcctggacttccggcaccgcgtgtccctcacgcgggaccgcgacctgttcaccgcccacatggacatccgggggctgacccagggcgacaccgccacgtacttctgcgcgcgccagaagttctacgccgggggccaggggtggtacttcgacctctggggccggggcaccctgatcgtggtcagctccgccagcaccaaggggccgtccgtgttcccccacgacctgcgc

SEQ ID NO: 11318 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcaggacgacaccgccacctacttctgcgcccgccagaagttcgcgcggggcgaccaggggtggttcttcgacctgtggggccgcgggaccctcatcgtggtgtccagcgcctccacgaagggccccagcgtcttcccccacgacctgcgg

SEQ ID NO: 11319 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgcccgcggggaccagggctggttcttcgacctgtgggggcggggcaccctcatcgtggtctccagcgcgtccacgaaggggcccagcgtgttcccccacgacctgcgc

SEQ ID NO: 11320 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcgagtccggcgtgaagaagctcggggccagcgtccgcgtgtcctgctggaccagcgaggacatcttcgagcggaccgagctgatccactgggtgcgccaggcgcccggccaggggctggagtggatcggctgggtcaaggccgtgtccggggccgtgaactacggcagcctcgacttccggcaccgcgtctccctgacgcgggaccgcgacctgttcaccgcccacatggacatccggggcctcacccaggacgacaccgccacgtacttctgcgcgcgccagaagttcgcccgcggggaccagggctggttcttcgacctgtgggggcggggcaccctgatcgtggtgagctccgccagcaccaaggggccgtccgtcttcccccacgacctccgg

SEQ ID NO: 11321 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttccccacgaccctgcgg

SEQ ID NO: 11322 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaagacggtgaccggcgccgtcaacttcggctccagcgacttccggcagcgcgtgtccctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtcagctccgcgagcacgaaggggccgtccgtgttcccccacgacctgcgc

SEQ ID NO: 11323 - RNA, 420 nt, synthetic construct
  misc_feature 1..420: note = derived and/or modified sequence opt1 from anti-HIV-1_HeavyChain
  source 1..420: mol_type = other RNA
caggcccgccccggcgccaaccgggggagcggcgtgaagaagccgggggcgtccgtccgcgtgagctgctggacctccgaggacatcttcgagcggaccgagctgatccactgggtgcgccaggcccccggccaggggctcgagtggatcggctgggtcaagatcgtgagcggcgccgtgaacttcgggtcccccaacttccggcagcgcgtcagcctgacgcgggaccgcgacctgttcaccgcccacatggacatccggggcctcacccagggggacaccgccacgtacttctgcgcgcgccagaagttcgagcggggcgggcagggctggatcttcgacctgtggggccgcgggaccctgatcgccgtgtccagcgcctccaccaagggccccagcgtgttcccgcacgacctccgg

SEQ ID NO: 11324 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatcgtggtgagctccgcgagcaccaaggggccctccgtcttcccccacgacctgcgc

SEQ ID NO: 11325 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctacttctgcgcgcggcagaagttctacaagggcgggcagggctggtacttcgacctgtggggccgcgggaccctcatcgtggtgagctccgccagcaccaagggcccctccgtcttcccccacgacctgcgg

SEQ ID NO: 11326 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggccccagcgtcctcccgccccggtccgcc

SEQ ID NO: 11327 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccgggatgaagaagcccggcgccagcgtgcgcgtctcctgctggagctccgaggacatcttcgagcggaccgagctcatccactgggtgcgccaggcgccggggcagggcctggagtggatcgggtgggtgaagaccgtcacgggcgccgtgaacttcggcagctccgacttccggcagcgcgtgagcctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtcgtgtccagcgcgtccaccaaggggcccagcgtgttcccccacgacctgcgc

SEQ ID NO: 11328 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaaggagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgccgtgtccagcgcgtccaccaaggggcccagcgtgttcccccagaccctgcgg

SEQ ID NO: 11329 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgccaccgggtgagcctcacccgcgaccgggacctgtccaccgcccacatggacatccgcggcctgacgcaggacgacaccgccacctacttctgcgcccggcagaagttcgcgcgcggcgaccaggggtggttcttcgacctctggggccgggggaccctgatcgtcgtgagctccgccagcacgaagggcccctccgtgttcccccacgacctgcgc

SEQ ID NO: 11330 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaccacggagctcatccactgggtgcggcaggcgccggggcagggcctggagtggatcgggtgggtcaagaccgtgtccggcgccgtgaacttcggcagcctgaacttccgccaccgggtctccctcacccgcgaccgggacctgttcaccgcccacatggacatccgcgggctgacgcagggcgacaccgccacctacttctgcgcccggcagaagttcgcgcgcggggaccagggctggttcttcgacctctgggggcggggcaccctgatcgtggtgagctccgccagcacgaagggcccctccgtcttcccccacgacctgcgc

SEQ ID NO: 11331 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaagacggtgaccggcgccgtcaacttcggctccccgaacttccggcaccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtctccagcgcgtccacgaaggggcccagcgtgttcccccacgacctgcgg

SEQ ID NO: 11332 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgagcggcgccgtgaacttcggctcccccaacttccggcaccgcgtcagcctgacccgggaccgcgacctcttcaccgcccacatggacatccgggggctgacccagggcgacacggccacctacttctgcgcgcgccagaagttcgagcgcgggggccaggggtggtacttcgacctgtggggccggggcaccctcatcgtggtgtccagcgcctccaccaaggggcccagcgtcttcccccacgacctgcgg

SEQ ID NO: 11333 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaactacggctccctgaacttccggagccgcatctccctcacccgggaccgcgacctgttcaccgcccacatggacatccgggggctgacggagggcgacaccgccacctacttctgcgcccgccagaagttctacgccgggggccaggggtggtacttcgacctctggggccggggcaccctgatcgtcgtgagctccgcgagcacgaaggggccctccgtgttcccccacgacctgcgc

SEQ ID NO: 11334 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgcctcgcgagcgaggacatcttcgagcggaccgagctgatccactgggtgcgccaggccccggggcagggcctggagtggatcgggtgggtcaagaccgtgacgggcgccgtgaacttcggctcccccaacttccggcaccgcgtcagcctcacccgggaccgcgacctgttcaccgcccacatggacatccgggggctgacccagggcgacacggccacctacttctgcgcgcgccagaagttcgagcgcgggggccaggggtggtacttcgacctctggggccggggcaccctgatcgtggtgtccagcgcctccaccaaggggcccagcgtcttcccccacgacctgcgg

SEQ ID NO: 11335 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagcgcgggggccaggggtggatcttcgacctctggggccggggcaccctgatcgcggtcagctccgccagcaccaaggggccctccgtgttcccccacgacctgcgg

SEQ ID NO: 11336 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttcccccacgacctgcgg

SEQ ID NO: 11337 - RNA, 417 nt, synthetic construct
  misc_feature 1..417: note = derived and/or modified sequence opt1 from anti-HIV-1_HeavyChain
  source 1..417: mol_type = other RNA
caggtgcacctggagcagagcggctccggggtcaagaagcccggcgccagcgtgcgcgtgtcctgctggaccagcgaggacatcttcgagcggaccgagctcatccactgggtccgccaggccccggggcagggcctggagtggatcgggtgggtgaagacggtgaccggcgcggtcaacttcggctcccccaacttccggcaccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtctccagcgcctccacgaaggggcccagcgtgttcccccacgacctgcgg

SEQ ID NO: 11338 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcagcgcgtctccctgacccgggaccgcgacctcttcaccgcccacatggacatccgggggctgacccagggcgacacggccacctacctgtgcgcccgccagaagttcgagcgcgggggccaggggtggatcttcgacctctggggccggggcaccctgatcgcggtgagctccgccagcaccaaggggccctccgtgttcccccacgacctgcgg

SEQ ID NO: 11339 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgccaccgggtgtccctgacccgcgaccgggacctcttcaccgcccacatggacatccgcggcctgacgcagggggacaccgccacctacttctgcgcccggcagaagttctacaagggcgggcagggctggtacttcgacctgtgggggcgcggcaccctcatcgtcgtgagctccgccagcacgaagggcccctccgtgttcccccacgacctgcgg

SEQ ID NO: 11340 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccccgaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgtccagcgcgtccaccaaggggagctccgtcttcccccacgacctgcgc

SEQ ID NO: 11341 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccccgaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgtccagcgcgtccaccaaggggcccagcgtcttcccccacgacctgcgc

SEQ ID NO: 11342 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggcccgagcgtcttcccccacgacctccgg

SEQ ID NO: 11343 - RNA, 417 nt, synthetic construct
  misc_feature 1..417: note = derived and/or modified sequence opt1 from anti-HIV-1_HeavyChain
  source 1..417: mol_type = other RNA
caggtgcacctggagcagagcggctccggggtcaagaagctcggcgccagcgtgcgcgtgtcctgctggaccagcgaggacatcttcgagcggaccgagctgatccactgggtccgccaggcccccgggcagggcctggagtggatcgggtgggtgaaggcggtgtccggcgccgtcaactacggcagcctcgacttccggcaccgcgtgtccctgacgcgggaccgcgacctgttcaccgcccacatggacatccgggggctcacccaggacgacaccgccacgtacttctgcgcccgccagaagttcgcgcggggcgaccaggggtggttcttcgacctgtggggccgcgggaccctgatcgtggtcagctccgccagcaccaagggcccgtccgtgttcccccaccggagcacc

SEQ ID NO: 11344 - RNA, 420 nt, synthetic construct
  misc_feature 1..420: note = derived and/or modified sequence opt1 from anti-HIV-1_HeavyChain
  source 1..420: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcccgggtcatcgtgagctccgccagcaccaagggcccctccgtgttcaccatctacgtc

SEQ ID NO: 11345 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccgtcttcccccacgaccccgcc

SEQ ID NO: 11346 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggccccagcgtcctcccgccccggtccacc

SEQ ID NO: 11347 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaaggccgtgagcggcgccgtgaactacggctccctggacttccggcaccgcgtcagcctcacccgggaccgcgacctgttcacggcccacatggacatccgggggctgacccaggacgacaccgccacctacttctgcgcgcgccagaagttcgcccggggcgaccaggggtggttcttcgacctctggggccgcgggacgctgatcgtggtgtccagcgcctccaccaagggccccagcgtcttcccccacgacctgcgg

SEQ ID NO: 11348 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccgagtggaagaagctcggggccagcgtgcgcgtctcctgctggaccagcgaggacatcttcgagcggaccgagctgatccactgggtgcgccaggcgcccggccaggggctggagtggatcggctgggtgaaggccgtctccggggccgtgaactacggcagcctcgacttccggcaccgcgtgtccctgacgcgggaccgcgacctgagcaccgcccacatggacatccggggcctcacccaggacgacaccgccacgtacttctgcgcgcgccagaagttcgcccgcggggaccagggctggttcttcgacctgtgggggcggggcaccctgatcgtcgtgtccagcgcctccaccaaggggccgagcgtgttcccccacgacctccgg

SEQ ID NO: 11349 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccgaggtgaagaagcccggggccagcgtccgcgtgtcctgctggaccagcgaggacatcttcgagaagtccgagctcatccactgggtgcggcaggcgccgggccaggggctggagtggatcggctgggtcaagaccgtgacgggggccgtgaacttcggcagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtggtgtccagcgcctccaccaagggccccagcgtcttcccccacgacctgcgg

SEQ ID NO: 11350 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgaccggcgccgtgaacttcggctccccgaacttccggcaccgcgtcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtggtgtccagcgcgtccacgaaggggcccagcgtcttcccccacgacctgcgg

SEQ ID NO: 11351 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcctccggaagtccgagctgatccactgggtgcgccaggcgccggggcagggcctggagtggatcgggtgggtcaagaccgtgacgggcgccgtgaacttcggcagctccgacttccggcagcgcgtcagcctcacccgggaccgcgacctgttcaccgcccacatggacatccgggggctgacccagggcgacacggccacctacttctgcgcccgccagaagttctacgccgggggccaggggtggtacttcgacctctggggccggggcaccctgatcgtggtgtccagcgcgtccaccaaggggcccagcgtcttcccccacgacctgcgc

SEQ ID NO: 11352 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcgcctccggcgtgaagcgccccggggcgagcgtccgggtgtcctgcctcgccagcgaggacatcttcgagcgctccgagctgatctactgggtgcggcaggccccgggccaggggctggagtggatcggctgggtcaagatcgtgagcggggccgtgaacttcggctcccccaacttccgccagcgggtcagcctcacccgcgaccgggacctgttcaccgcccacatggacatccgcggcctgacgcagggggacaccgcgacctacttctgcgcccggcagaagttcgagcgcggcgggcagggctggatcttcgacctctgggggcggggcaccctgatcgccgtgtccagcgcctccacgaagggccccagcgtgttcccccacgacctgcgc

SEQ ID NO: 11353 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgaccggcgccgtgaacttcggctccgcctacttccggcaccgcgtcagcctgacccgggaccgcgacctcttcacggcccacatggacatccgggggctgacccagggcgacaccgccacctacttctgcgcgcgccagaagttctacaagggcgggcaggggtggtacttcgacctgtggggccggggcacgctcatcgtggtgtccagcgcctccaccaaggggcccagcgtcttcccccacgacctgcgc

SEQ ID NO: 11354 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgagcggggccgtgaacttcggctccacggacttccgccaccgggtcagcctgacccgcgaccgggacctcttcaccgcccacatggacatccgcggcctgacccagggggacacggccacctacttctgcgcgcggcagaagttcgagcgcggcgggcagggctggtacttcgacctgtgggggcggggcaccctcatcgtggtgtccagcgcctccaccaagggccccagcgtcttcccccacgacctgcgc

SEQ ID NO: 11355 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggccccagcggcctcccgccccggtccgcc

SEQ ID NO: 11356 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccagggcgacacggccacctacttctgcgcccggcagaagttcgagcgcgggggccaggggtggatcttcgacctctggggccgggggaccctgatcgcggtgtccagcgcctccaccaagggccccagcgtcttccccctgcgctccgcc

SEQ ID NO: 11357 - RNA, 423 nt, synthetic construct
  misc_feature 1..423: note = derived and/or modified sequence opt1 from anti-HIV-1_HeavyChain
  source 1..423: mol_type = other RNA
caggtgcagatggagcaggccggcgccgggatgaagaagcccggcgcgagcatgaccgtctcctgcaagaccgccgacgaggacatcttcgacgccgcctacatgcactgggtgcgccaggccccggggcagacgttcgagtggctgggctggatgaagcccgtgaccggggcggtcaactacgcccggcagttccagggccgcgccagcttctaccggacccgcgagctcggcatcgcctacatggacctgcgggacctgaagttcgacgacaccgcggtgtacttctgcgcccgcaagacgaagggggacgtgtccggcgacgaccgggggttcttcttcgacctctggggccgcgggacccgggtcatcgtgagctccgccagcaccaagggcccctccgtgttcccccacgacctgcgc

SEQ ID NO: 11358 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttctacaagggcgggcaggggtggtacttcgacctctggggccggggcaccctgatcgtcgtgagctccgcgagcaccaaggggccctccgtgttcccccagatctgccgc

SEQ ID NO: 11359 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggcgccggggtgaagaagcccggcgcgtccgtccgcgtgagctgctggacctccgaggacatcttcgagaagtccgagctcatccactgggtgcggcaggccccggggcagggcctggagtggatcgggtgggtcaagaccgtgacgggcgccgtgaacctggtccaccagatcagcgaccgcgtgagcctcacccgggaccgcgacctgtccaccgcccacatggacatccggggcctgacccaggacgacacggccacctacttctgcgcgcgccagaagttcgcccgcggggaccagggctggttcttcgacctctgggggcggggcaccctgatcgtggtcagctccgccagcaccaaggggccctccgtgttcccccacgacctgcgg

SEQ ID NO: 11360 - RNA, 420 nt, synthetic construct
  misc_feature 1..420: note = derived and/or modified sequence opt1 from anti-HIV-1_HeavyChain
  source 1..420: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggccccagcggcctcccgccccggctgtgcgtc

SEQ ID NO: 11361 - RNA, 417 nt, synthetic construct
  misc_feature 1..417: note = derived and/or modified sequence opt1 from anti-HIV-1_HeavyChain
  source 1..417: mol_type = other RNA
caggcccgcctggagcagagcggctccggggtgaagaagcccggcgccagcgtccgggtgtcctgctggaccagcgaggacatcttcgaggggtccgagctcatccactgggtgcgccaggcgccgggccaggggctggagtggatcggctgggtcaagaccgtgacgggcgccgtgaacttcgggagcgcctacttccggcaccgcgtctccctgacccgggaccgcgacctcttcaccgcccacatggacatccggggcctgacccagggggacacggccacctacttctgcgcgcgccagaagttcgcccggggcgaccaggggtggttcttcgacctgtggggccgcggcaccctcatcgtggtgagctccgccagcaccaaggggccctccgtcttcccccacgacagcgcc

SEQ ID NO: 11362 - RNA, 414 nt, synthetic construct
  misc_feature 1..414: note = derived and/or modified sequence opt1 from anti-HIV-1_HeavyChain
  source 1..414: mol_type = other RNA
caggtgcagctggtccagagcggcgccgaggtgaagaagcccgggtccagcgtgaaggtctcctgcaaggtgagcggcggggtgttcacctcctacgccgtcacctgggtgcgccaggcgccgggccaggggctcgagtggatcggctgggtgaaggccgtcagcggcgccgtgaactacgggtccctggacttccggcaccgcgtgagcctgacgcgggaccgcgacctcttcaccgcccacatggacatccggggcctgacccaggacgacaccgccatctacttctgcgcgcgccagaagttcgcccgcggggaccagggctggttcttcgacctgtgggggcggggcacgctcatcgtcgtgtccagcgcctccaccaagggccccagcgtgttcccccacgacctgcgg

SEQ ID NO: 11363 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcagcgcgtctccctgacccgggaccgcgacctcttcaccgcccacatggacatccgggggctgacccagggcgacacggccacctacttctgcgcccgccagaagttcgagcgcgggggccaggggtggatcttcgacctgtggggccggggcaccctcatcgcggtgagctccgccagcaccaaggggccctccgtgttcccccacgacctgcgg

SEQ ID NO: 11364 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgaccgtcagctgctggacctccgaggacatcttcgacacgaccgagctcatctactgggtgcgccaggcgccgggccaggggctggagtggatcggctgggtgaagatcgtcagcgggaccgtgaacttcgcctccctggacttccggaaccgcatcagcctctcccgggaccgcgacctgagcaccgcccacatggacatccggggcctgacgcaggacgacaccgccacctacttctgcgcccgccagaagttcgcgtcccggtacagcggcgaccaggggtcctacttcgacctctggggccgcgggaccctgatcatcgtgagctccgccagcacgaagggcccctccgacgacctgcgg

SEQ ID NO: 11365 - RNA, 414 nt, synthetic construct
  misc_feature 1..414: note = derived and/or modified sequence opt1 from anti-HIV-1_HeavyChain
  source 1..414: mol_type = other RNA
caggtgcagctggtccagagcggcgccgaggtgaagaagcccggggcctccgtgaaggtcagctgcaagtccagcggctactccttcacccgcttcgacatcacctgggtgcggcaggcgccggggcagggcctcgagtggatcgggtgggtgaagacggtcagcggcgccgtgaacttcggctccctgaacttccgccaccgggtgagcctgacccgcgaccgggacctcttcaccgcccacatggacatccgcgggctgacccagggcgacacggccacctacttctgcgcccggcagaagttcgcgcgcggggaccagggctggttcttcgacctgtgggggcggggcaccctcatcgtcgtgtccagcgcctccaccaagggccccagcgtgttcccccacgacctgcgc

SEQ ID NO: 11366 - RNA, 420 nt, synthetic construct
  misc_feature 1..420: note = derived and/or modified sequence opt1 from anti-HIV-1_HeavyChain
  source 1..420: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgcccgggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccatcggcctgccgccccggctgtgcgtc

SEQ ID NO: 11367 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgaccggcgccgtgaacttcggcagccccaacttccggcaccgcgtctccctgacccgggaccgcgacctcttcaccgcccacatggacatccgggggctgacgcagggcgacaccgccacctacttctgcgcgcgccagaagttcgagcgcgggggccaggggtggtacttcgacctgtggggccggggcaccctcatcgtggtgagctccgccagcacgaaggggccctccgtcttcccccacgacctgcgg

SEQ ID NO: 11368 - RNA, 420 nt, synthetic construct
  misc_feature 1..420: note = derived and/or modified sequence opt1 from anti-HIV-1_HeavyChain
  source 1..420: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccggccccagccccgagatctgcgtc

SEQ ID NO: 11369 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggcgccggggtgaagcgccccggcgcgtccgtccgggtgagctgctggacctccgaggacatcttcgagaccacggagctcatccactgggtgcgccaggccccggggcagggcctggagtggatcgggtgggtcaagaccgtgagcggcgccgtgaacttcggctccctgaacttccggcaccgcgtcagcctcacccgggaccgcgacctgttcaccgcccacatggacatccgggggctgacgcagggcgacaccgccacctacttctgcgcgcgccagaagttcgcccgcggggaccagggctggttcttcgacctctgggggcggggcaccctgatcgtggtgtccagcgcctccacgaagggccccagcgtcttcccccacgacctgcgg

SEQ ID NO: 11370 - RNA, 417 nt, synthetic construct
  misc_feature 1..417: note = derived and/or modified sequence opt1 from anti-HIV-1_HeavyChain
  source 1..417: mol_type = other RNA
cgcgcccacctggagcagagcggctccggggtgaagaagctcggcgccagcgtccgggtgtcctgctggaccagcgaggacatcttcgagcgcaccgagctgatccactgggtgcggcaggcgcccgggcagggcctggagtggatcgggtgggtcaaggccgtgtccggcgccgccaactacggcagcccgaacttccgccagcgggtgtccctcacgcgcgaccgggacctgttcaccgcccacatggacatccgcgggctgacccagggcgacaccgcgacgtacttctgcgcccggcagaagttcgagcgcgggggccaggggtggatcttcgacctctggggccggggcaccctgatcgccgtcagctccgccagcaccaaggggccctccgtgttcccccacgacctgcgc

SEQ ID NO: 11371 - RNA, 417 nt, synthetic construct
  misc_feature 1..417: note = derived and/or modified sequence opt1 from anti-HIV-1_HeavyChain
  source 1..417: mol_type = other RNA
caggtgcacctggagcagagcggctccggggtcaagaagctcggcgccagcgtgcgcgtgtcctgctggaccagcgaggacatcttcgagcggaccgagctgatccactgggtccgccaggcccccgggcagggcctggagtggatcgggtgggtgaaggcggtgtccggcgccgtcaactacggcagcctcgacttccggcaccgcgtgtccctgacgcgggaccgcgacctgttcaccgcccacatggacatccgggggctcacccaggacgacaccgccacgtacttctgcgcccgccagaagttcgcgcggggcgaccaggggtggttcttcgacctgtggggccgcgggaccctgatcgtggtcagctccgccagcaccaagggcccgtccgtgttcccccacgacctccgg

SEQ ID NO: 11372 - RNA, 417 nt, synthetic construct
  misc_feature 1..417: note = derived and/or modified sequence opt1 from anti-HIV-1_HeavyChain
  source 1..417: mol_type = other RNA
cgcgcccacctggagcagagcggctccggggtgaagaagcccggcgccagcgtccgggtgtcctgctggaccagcgaggacatcttcgagcgcaccgagctcatccactgggtgcggcaggcgccggggcagggcctggagtggatcgggtgggtcaagatcgtgtccggcgccgtgaacttcggcagccccaacttccgccagcgggcctccctgacgcgcgaccgggacctcttcaccgcccacatggacatccgcgggctgacccagggcgacaccgccacgtacttctgcgcgcggcagaagttcgagcgcgggggccaggggtggatcttcgacctgtggggccggggcaccctcatcgccgtcagctccgccagcaccaaggggccctccgtgttccccaccatctacgtg

SEQ ID NO: 11373 - RNA, 414 nt, synthetic construct
  misc_feature 1..414: note = derived and/or modified sequence opt1 from anti-HIV-1_HeavyChain
  source 1..414: mol_type = other RNA
caggtgcagctggtccagagcgaggccgaggtgaagaagcccggcgcctccgtgaagatcagctgcgcgacctccgggtacgccttcaccctctactacctgcactgggtccgccaggccccgggccaggggctggagtggatcggctgggtgaagacggtgaccggggccgtcaacttcggcagcgcctacttccggcaccgcgtgtccctcacccgggaccgcgacctgttcaccgcgcacatggacatccggggcctgacgcagggggacaccgccacctacttctgcgcccgccagaagttctacaagggcgggcagggctggtacttcgacctctgggggcggggcaccctgatcgtggtcagctccgccagcacgaagggcccctccgtgttcccccacgacctgcgc

SEQ ID NO: 11374 - RNA, 420 nt, synthetic construct
  misc_feature 1..420: note = derived and/or modified sequence opt1 from anti-HIV-1_HeavyChain
  source 1..420: mol_type = other RNA
caggcccaccccgagcagagcggctccggggtgaagaagccgggcgccagcgtccgcgtgtcctgctggaccagcgaggacatcttcgagcggaccgagctgatccactgggtgcgccaggcgcccgggcagggcctcgagtggatcgggtgggtcaagatcgtgtccggcgccgtgaacttcggcagccccaacttccggcagcgcgtctccctgacgcgggaccgcgacctgttcaccgcccacatggacatccgggggctcacccagggcgacaccgccacgtacttctgcgcccgccagaagttcgagcgcgggggccaggggtggatcttcgacctgtggggccggggcaccctgatcgcggtgagctccgccagcaccaaggggccctccggcctcccgccccggctgtgcgtg

SEQ ID NO: 11375 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctccgcgagcaccaaggggccctccgtcttcccgccccggagcacg

SEQ ID NO: 11376 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagcgccccggcgccagcgtccgggtgtcctgctggaccagcgaggacatcttcgagaagtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctccgcgagcaccaaggggccctccgtcttcccccacgacctgcgg

SEQ ID NO: 11377 - RNA, 417 nt, synthetic construct
  misc_feature 1..417: note = derived and/or modified sequence opt1 from anti-HIV-1_HeavyChain
  source 1..417: mol_type = other RNA
ggcgcccacctggagcagagcgggtccggcgtgaagaagcccggggccagcgtccgcgtgtcctgctggaccagcgaggacatcttcgagaagtccgagctcatccactgggtgcggcaggcgccgggccaggggctggagtggatcggctgggtcaagaccgtgacgggcgccgtgaacttcgggagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtggggccgcgggaccctcatcgtggtgtccagcgcctccaccaagggccccagcgtcttcccccacgacctgcgg

SEQ ID NO: 11378 - RNA, 417 nt, synthetic construct
  misc_feature 1..417: note = derived and/or modified sequence opt1 from anti-HIV-1_HeavyChain
  source 1..417: mol_type = other RNA
cgccacgacctggagcagagcggctccggggtgaagaagcccggcgccagcgtccgggtgtcctgctggaccagcgaggacatcttcgagcgcaccgagctcatccactgggtgcggcaggccccggggcagggcctggagtggatcgggtgggtcaagatcgtgtccggcgcggtgaacttcggcagccccaacttccgccagcgggtctccctgacgcgcgaccgggacctcttcaccgcccacatggacatccgcgggctgacccagggcgacaccgccacgtacttctgcgcccggcagaagttcgagcgcgggggccaggggtggatcttcgacctgtggggccggggcaccctcatcgccgtgagctccgcgagcaccaaggggccctccgtgttcccccacgacctgcgc

SEQ ID NO: 11379 - RNA, 420 nt, synthetic construct
  misc_feature 1..420: note = derived and/or modified sequence opt1 from anti-HIV-1_HeavyChain
  source 1..420: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaaggggcccagcgtgaccatctacgtc

SEQ ID NO: 11380 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtcccccgggcccatcggccccagcccgcggtccgcc

SEQ ID NO: 11381 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcgcctccggcgtgaagcgccccggggcgagcgtccgggtgtcctgctggaccagcgaggacatcttcgagcgcaccgagctcatccactgggtgcggcaggccccgggccaggggctggagtggatcggctgggtcaagacggtgaccggggccgtgaacttcggctccagcgacttccgccagcgggtctccctgacccgcgaccgggacctcttcaccgcccacatggacatccgcggcctgacgcagggggacaccgccacctacttctgcgcgcggcagaagttctacgccggcgggcagggctggtacttcgacctgtgggggcgcggcaccctcatcgtggtgagctccgccagcacgaagggcccctccgtcttcccccacgacctgcgg

SEQ ID NO: 11382 - RNA, 417 nt, synthetic construct
  misc_feature 1..417: note = derived and/or modified sequence opt1 from anti-HIV-1_HeavyChain
  source 1..417: mol_type = other RNA
caggtgcagctggtccagagcggcgccgaggtgaagaagcccggggcctccgtgcgcgtcagctgctggacctccgaggacatcttcgagaagtccgagctcatccactgggtgcggcaggcgccgggccaggggctggagtggatcggctgggtgaagaccgtcacgggggccgtgaacttcggcagcagcgacttccgccagcgggtgtccctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtcgtgagctccgccagcaccaagggcccctccgtgttccccacgatctacgtc

SEQ ID NO: 11383 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagcggatcgggtgggtcaagacggtgaccggcgccgtgaacttcggctcccccaacttccgccaccgggtcagcctgacccgcgaccgggacctcttcaccgcccacatggacatccgcgggctgacgcagggcgacaccgccacctacttctgcgcccggcagaagttcgagcgcgggggccaggggtggtacttcgacctgtggggccggggcaccctcatcgtggtgtccagcgcgtccacgaaggggcccagcgtcttccccaccatctgcgtg

SEQ ID NO: 11384 - RNA, 420 nt, synthetic construct
  misc_feature 1..420: note = derived and/or modified sequence opt1 from anti-HIV-1_HeavyChain
  source 1..420: mol_type = other RNA
cagagccacctggagcagtccggcagcgccatgaagaagcccggggcctccgtgcgcgtcagctgctggacctccgaggacatcttcgacaccacggagctcatccactgggtgcggcaggcgccgggccaggggctggagtggatcggctgggtgaagaccgtcagcggggccgtgaacttcggctccctgaacttccgccaccgggtgagcctcacccgcgaccgggacctgttcaccgcccacatggacatccgcggcctgacgcagggggacaccgccacctacttctgcgcccggcagaagttcgcgcgcggcgaccaggggtggttcttcgacctctggggccgggggaccctgatcgtcgtgtccagcgcctccacgaacggccccatcggccccagccccaccgacctgcgc

SEQ ID NO: 11385 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccagtgggtgcgccaggcgcccgggcagggcctggagtggatggggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccgtcttcccccacgacctccgg

SEQ ID NO: 11386 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaaggccgtcagcggggccgtgaactacggctccctggacttccgccaccgggtgagcctcacccgcgaccgggacctgtccaccgcccacatggacatccgcggcctgacccaggacgacacggccacctacttctgcgcgcggcagaagttcgcccgcggggaccagggctggttcttcgacctctgggggcggggcaccctgatcgtcgtgagctccgccagcaccaaggggccctccgtgttcccccacgacctgcgc

SEQ ID NO: 11387 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggcccgagcgtcttccccaccatctacgtg

SEQ ID NO: 11388 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttcccccacgacccgcgg

SEQ ID NO: 11389 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccgggatgaagaagcccggcgcgagcatgaccgtctcctgcaagaccgccgacgaggacatcttcgacgccgcctacatgcactgggtgcgccaggccccggggcagacgttcgagtggctgggctggatgaagcccgtgaccggggcggtcaactacgcccggcagttccagggccgcgtgagcttctaccggacccgcgagctcggcatcgcctacatggacctgcgggacctgaagttcgacgacaccgccgtgtacttctgcgcgcgcaagacgaagggggacgtctccggcgacgaccgggggttcttcttcgacctctggggccgcgggacccgggtgatcgtgagctccgccagcaccaagggcccctccgtcttcccccacgacctgcgc

SEQ ID NO: 11390 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggcccggggccagacgttcgagtggctggggtggatgaagccggtgaccggcgccgtcaactacgcgcgccagttccagggccgggtgagcttctaccgcacccgggagctcgggatcgcctacatggacctgcgcgacctgaagttcgacgacaccgccgtgtacttctgcgcccggaagacgaagggcgacgtctccggggacgaccgcggcttcttcttcgacctctgggggcggggcacccgcgtgatcgtgagctccgcgagcaccaagggcccctccgtcttccccaccatctacgtg

SEQ ID NO: 11391 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcccgggtcatcgtgagctccgccagcaccaagggcccctccgtgttccccaccatctacgtc

SEQ ID NO: 11392 - RNA, 423 nt, synthetic construct
  misc_feature 1..423: note = derived and/or modified sequence opt1 from anti-HIV-1_HeavyChain
  source 1..423: mol_type = other RNA
caggtgtacagcggcgccgggcgcggcggggtcaagaagcccggcgcctccgtgaccctgagctgcaagaccgcggacgaggacgtgttcgacgccgcctacatgcactgggtccggcaggccccggggcagacgttcgagtggctcggctggatgaagcccgtgaccggcgccgtgaactacgcgcgcaagttccaggggcgggtctccttctaccgcacccgggagctgggcatcgcctacatggacctgcgcaacctccggttcgacgacaccgccgtgtacttctgcgcccgcaagacggcgggggacgtgagcggcgacaagcgggggttcttcttcgacctgtggggccgcggctcccgggtcatcgtgagctccgccagcaccaaggggccctccgtgttccccaccatctacgtc

SEQ ID NO: 11393 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctccgcgttcaccaaggggcccagcgtcttcccccacgacctgcgg

SEQ ID NO: 11394 - RNA, 414 nt, synthetic construct
  misc_feature 1..414: note = derived and/or modified sequence opt1 from anti-HIV-1_HeavyChain
  source 1..414: mol_type = other RNA
caggtgcagctgggccagagcggggccgagatgaagaagcccggctccagcgtcaaggtgtcctgcaaggccagcgggggcaccttccgccactccccgatcagctgggtgcggcaggcgcccgggcagggcctcgagtggatcggctgggtcaaggccgtgtccggggccgtgaactacggcagcctggacttccgccaccgggtctccctgacccgcgaccgggacctcagcacggcccacatggacatccgcgggctgacccaggacgacaccgccacctacttctgcgcgcggcagaagttcgcccgcggcgaccaggggtggttcttcgacctgtggggccggggcacgctcatcgtggtgtccagcgcctccaccaaggggcccagcgtcttcccccacgacctgcgc

SEQ ID NO: 11395 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagaccgtcaccggggccgtgaacttcggcagccccaacttccgccaccgggtgtccctgacccgcgaccgggacctcttcacggcccacatggacatccgcggcctgacccagggggacaccgccacctacttctgcgcccggcagaagttcgagcgcggcgggcagggctggtacttcgacctgtgggggcggggcacgctcatcgtcgtgagctccgcgagcaccaagggcccctccgtgttcccccacgacctgcgc

SEQ ID NO: 11396 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcctgggtcatcgtgagctccgccagcaccaagggcccctccgtgttcccccacgacctgcgg

SEQ ID NO: 11397 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagcgcctccaccaagggccccagcgtgttccccaccatctgcgtc

SEQ ID NO: 11398 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccaggacgacaccgccacgtacttctgcgcgcggcagaagttcgcccgcggcgaccaggggtggttcttcgacctgtggggccgggggaccctgatcgtggtgagctccgccagcaccaagggcccgtccgtcttcccccacgacctccgc

SEQ ID NO: 11399 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagcgcctccaccaagggccccagcgtgttccccaccatctacgtc

SEQ ID NO: 11400 - RNA, 423 nt, synthetic construct
  misc_feature 1..423: note = derived and/or modified sequence opt1 from anti-HIV-1_HeavyChain
  source 1..423: mol_type = other RNA
caggtgttcatggagcaggccggcgccgggatgaagaagcccggcgcgagcatgaccgtctcctgcaagaccgccgacgaggacgtgttcgacgccgcctacatgcactgggtgcgccaggccccggggcagacgttcgagtggctgggctggatgaagcccgtcaccggggcggtgaactacgcccggaagttccagggccgcgtgagcttctaccggacccgcgagctcggcatcgcctacatggacctgcggaacctgcgcttcgacgacaccgccgtctacttctgcgcgcggaagacggccggggacgtgtccggcgacaagcgcgggttcttcttcgacctctggggccgggggagccgcgtgatcgtctccagcgcctccaccaagggccccagcgtgttcccccacgacctgcgg

SEQ ID NO: 11401 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgaactacgcccggaagttccagggccgcgtcagcttctaccggacccgcgagctgggcatcgcctacatggacctgcggaacctccgcctggacgacaccgccgtgtacttctgcgcgcggaagacggccggggacgtgtccggcgacaagcgcgggttcttcttcgacctgtggggccgggggagccgcgtcatcgtgtccagcgcctccaccaagggccccagcgtgttcccccacgacctccgg

SEQ ID NO: 11402 - RNA, 420 nt, synthetic construct
  misc_feature 1..420: note = derived and/or modified sequence opt1 from anti-HIV-1_HeavyChain
  source 1..420: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagcacgaagggcccctccgtcttccccaccatc

SEQ ID NO: 11403 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcccgggtcatcgtgagctccgccagcaccaagggcccctccgtgttccccaccatctgcgtc

SEQ ID NO: 11404 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagtactacgccgggggccaggggtggtacttcgacctgtggggccgcggcaccctcatcgtggtgtccagcgcgtccaccaaggggcccagcgtcttcccccacgacctgcgg

SEQ ID NO: 11405 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaaggggcccagcgtgttcccccacgacctgcgg

SEQ ID NO: 11406 - RNA, 423 nt, synthetic construct
  misc_feature 1..423: note = derived and/or modified sequence opt1 from anti-HIV-1_HeavyChain
  source 1..423: mol_type = other RNA
caggtgtacatgggcgccgggcgcggcggggtcaagaagcccggcgccagcgtgaccctgtcctgcaagaccgcggacgaggacgtgttcgacgccgcctacatgcactgggtccggcaggccccggggcagacgttcgagtggctcggctggatgaagcccgtgaccggcgccgtgaactacgcgcgcaagttccaggggcgggtcagcttctaccgcacccgggagctgggcatcgcctacatggacctgcgcaacctccggttcgacgacaccgccgtgtacttctgcgcccgcaagacggcgggggacgtgtccggcgacaagcgggggttcttcttcgacctgtggggccgcggcagccgggtcatcgtgtccagcgcctccaccaaggggcccagcgtgttccccaccatctacgtc

SEQ ID NO: 11407 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttctaccggacccgcgagctcgggatcgcctacatggacctgcgggacctgaagttcgacgacaccgccgtgtacttctgcgcccgcaagacgaagggcgacgtctccggggacgaccggggcttcttcttcgacctctgggggcgcggcacccgggtgatcgtgagctccgcgagcaccaagggcccctccgtcttccccaccatctgcgtg

SEQ ID NO: 11408 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttctaccggacccgcgagctcgggatcgcctacatggacctgcgggacctgaagttcgacgacaccgccgtgtacttctgcgcccgcaagacgaagggcgacgtctccggggacgaccggggcttcttcttcgacctctgggggcgcggcacccgggtgatcgtgagctccgcgagcaccaagggcccctccgtcttcccccacgacctgcgc

SEQ ID NO: 11409 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgaactacgcccggaagttccagggcaaggtcagcttctaccgcacccgggagctgggcatcgcctacatggacctgcgcaacctccggttcgacgacaccgccgtgtacttctgcgcgcgcaagacggccggggacgtgtccggcgacaagcgggggttcttcttcgacctgtggggccgcgggagccgggtcatcgtgtccagcgcctccaccaagggccccagcgtgttcccccacgacctgcgc

SEQ ID NO: 11410 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgaactacgcccggaagttccagagccgcgtctccttctacggcacccgggagctgggcatcgcctacatggacctgcgcaacctccggttcgacgacaccgccgtgtacttctgcgcgcgcaagacggccggggacgtgagcggcgacaagcgggggttcttcttcgacctgtggggccgcgggtcccgggtcatcgtgagctccgccagcaccaagggcccctccgtgttcccccacgacctgcgc

SEQ ID NO: 11411 - RNA, 420 nt, synthetic construct
  misc_feature 1..420: note = derived and/or modified sequence opt1 from anti-HIV-1_HeavyChain
  source 1..420: mol_type = other RNA
cagggccacaccgtggagcagagcgggtccggcgtcaagaagctgggggccagcgtgcgcgtgtcctgctggaccagcgaggacatcttcgagacgaccgagctcatccactgggtccggcaggcccccggccaggggctggagtggatcggctgggtgaagaccgtgtccggcgcggtcaacttcgggagcctgaacttccgccaccgggtgtccctcacccgcgaccgggacctgttcacggcccacatggacatccgcggcctgacccagggggacaccgccacctacttctgcgcccggcagaagttcgcccgcggcgaccaggggtggttcttcgacctctggggccggggcacgctgatcgtggtcagctccgcgagcaccaaggggccgtccgtgttcccccacgacctgcgc

SEQ ID NO: 11412 - RNA, 420 nt, synthetic construct
  misc_feature 1..420: note = derived and/or modified sequence opt1 from anti-HIV-1_HeavyChain
  source 1..420: mol_type = other RNA
caggccaccccctggagcaacctgggccgcggggtgaagaagctcggcgcctccgtccgggtgagctgctggacctccgaggacatcttcgagcgcacggagctgatccactgggtgcggcaggcgccggggcagggcctggagtggatcgggtgggtcaagaccgtgaccggcgccgtgaacttcggcagccccaacttccgccaccgggtctccctcacccgcgaccgggacctgttcacggcccacatggacatccgcgggctgacccagggcgacaccgccacctacttctgcgcccggcagaagttcgagcgcgggggccaggggtggtacttcgacctctggggccggggcacgctgatcgtggtgagctccgcgagcaccaaggggccctccgtcttcccccacgacctgcgc

SEQ ID NO: 11413 - RNA, 423 nt, synthetic construct
  misc_feature 1..423: note = derived and/or modified sequence opt1 from anti-HIV-1_HeavyChain
  source 1..423: mol_type = other RNA
caggtgttcatggagcaggccggcgccgggatgaagaagcccggcgcgagcatgaccgtctcctgcaagaccgccgacgaggacgtgttcgacgccgcctacatgcactgggtgcgccaggccccggggcagacgttcgagtggctgggctggatgaagcccgtcaccggggcggtgagctacgcccggaagttccagggccgcgtgtccttctacatgacccgggagctcggcatggcctacatggacctgcgcaacctgcggttcgacgacaccgccgtctacttctgcgcgcgcaagacggccggggacgtgagcggcgacaaccgggggtacttcttcgacctctggggccgcgggtcccgggtgatcgtcagctccgccagcaccaagggcccctccgtgttcccccacgacctgcgc

SEQ ID NO: 11414 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcagagcggcgggggcgtcaagaagcccggggcctccgtgaccctgagctgcaagaccgccgacgaggacgtgttcgacgcggcctacatgcactgggtccgccaggccccgggccagacgttcgagtggctcgggtggatgaagcccgtgaccggcgccgtgtcctacgcccggaagttccagggccgcgtcagcttctaccggacccgcgagctggggatcgcgtacatggacctgcggaacctccgcttcgacgacaccgccgtgtacttctgcgcccggaagacggccggcgacgtgtccggggacaagcgcggcttcttcttcgacctgtgggggcggggcagccgcgtcatcgtgtccagcgcgtccaccaagggccccagcgtgttcccccacgacctgcgg

SEQ ID NO: 11415 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcgcggccgcgggggcgtcaagaagcccggggccagcgtgaccctgtcctgcaagaccgccgacgaggacgtgttcgacgcggcctacatgcactgggtccggcaggccccgggccagacgttcgagtggctcgggtggatgaagcccgtgaccggcgccgtgaactacgcccggaagttccagggccgcgtcagcttctaccggacccgcgagctggggatcgcgtacatggacctgcggaacctccgcttcgacgacaccgccgtgtacttctgcgcccggaagacggccggcgacgtgtccggggacaagcgcggcttcttcttcgacctgtgggggcggggcagccgcgtcatcgtgtccagcgcgtccaccaagggccccagcgtgttcccccacgacctgcgg

SEQ ID NO: 11416 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggcgcttccagggccgggtctccttctacatgacccgcgagctggggatggcctacatggacctgcggaacctccgcttcgacgacaccgccgtgtacttctgcgcccggaagacggcgggcgacgtgagcggggacaaccgcggctacttcttcgacctgtgggggcggggctcccgcgtcatcgtgagctccgccagcaccaagggcccctccgtgttccccaccatctgcgtc

SEQ ID NO: 11417 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcccgggtcatcgtgagctccgccagcaccaagggcccctccgtgttcccccacgacctgcgc

SEQ ID NO: 11418 - RNA, 423 nt, synthetic construct
  misc_feature 1..423: note = derived and/or modified sequence opt1 from anti-HIV-1_HeavyChain
  source 1..423: mol_type = other RNA
caggtgttcatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttctaccggacccgcgagctcgggatcgcctacatggacctgcgggacctgaagttcgacgacaccgccgtgtacttctgcgcccgcaagacgaagggcgacgtctccggggacgaccggggcttcttcttcgacctctgggggcgcggcacccgggtgatcgtgagctccgcgagcaccaagggcccctccgtcttcccccacgacctgcgc

SEQ ID NO: 11419 - RNA, 423 nt, synthetic construct
  misc_feature 1..423: note = derived and/or modified sequence opt1 from anti-HIV-1_HeavyChain
  source 1..423: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgcgtcccggtacagcggggaccagggctcctacttcgacctctgggggcgcggcaccctgatcgtcgtgagctccgccagcacgaagggcccctccgtgttcccccacgacctg

SEQ ID NO: 11420 - RNA, 423 nt, synthetic construct
  misc_feature 1..423: note = derived and/or modified sequence opt1 from anti-HIV-1_HeavyChain
  source 1..423: mol_type = other RNA
caggtgttcatggagcaggccggcgccgggatgaagaagcccggcgcgagcatgaccgtctcctgcaagaccgccgacgaggacgtgttcgacgccgcctacatgcactgggtgcgccaggccccggggcccgacctggagtggctcggctggatgaagcccgtcacgggggcggtgaactacgcccggaagttccagggccgcgtgagcttctaccggacccgcgagctgggcatcgcctacatggacctgcgggacctccgcttcgacgacaccgccgtctacttctgcgcgcggaagaccgccggggacgtgtccggcgacaagcgcgggttcttcttcgacctgtggggccgggggagccgcgtgatcgtctccagcgcctccacgaaggcccaccggagctcccccaccatctgcgtg

SEQ ID NO: 11421 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcatcagcctgacccgggaccgcgacctcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtcgtgagctccgcgagcaccaaggggccctccgtgttcccccacgacctccgg

SEQ ID NO: 11422 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcaacgacaccgccgtgtacttctgcgcccgcaagacggcgggcgacgtgagcggggacaaccggggctacttcttcgacctgtgggggcgcggctcccgggtcatcgtgagctccgccagcaccaagggcccctccgtgttcccccacgacctgcgc

SEQ ID NO: 11423 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaaccgcggctacttcttcgacctgtgggggcggggcagccgcgtcatcgtgtccagcgcctccaccaagggccccagcgggctgccccacgacctccgg

SEQ ID NO: 11424 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacggcaccgccgtgtacttctgcgcccggaagacggcgggggacgtgtccggcgacaagcgcgggttcttcttcgacctgtggggccggggcagccgcgtcatcgtgtccagcgcctccaccaaggggcccagcgtgttcccccacgacctgcgg

SEQ ID NO: 11425 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagcgcctccaccaagggccccagcgtgttcccccacgacctgcgg

SEQ ID NO: 11426 - RNA, 423 nt, synthetic construct
  misc_feature 1..423: note = derived and/or modified sequence opt1 from anti-HIV-1_HeavyChain
  source 1..423: mol_type = other RNA
caggtgcagctggtccagagcggcgccgaggtgaagaagcccggggcctccctcaaggtgagctgcaaggcgtccggctacaccttcaccgactactacatccactgggtccgccaggccccggggcagggcctggagtggatcgggtgggtgaagatcgtgagcggcacggtcaacttcgcctccctggacttccggaaccgcatcagcctctcccgggaccgcgacctgagcaccgcctacatggacatccggggcctgacccaggacgacaccgccacgtacttctgcgcgcgccagaagttcgcctcccggtacagcggggaccagggctcctacttcgacctctgggggcgcggcaccctgatcgtggtgagctccgccagcaccaaggggccctccgtcttcccccacgacctgcgg

SEQ ID NO: 11427 - RNA, 423 nt, synthetic construct
  misc_feature 1..423: note = derived and/or modified sequence opt1 from anti-HIV-1_HeavyChain
  source 1..423: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcaccctgatcgtcgtgtccagcgcgtccacgcgggcccaccgcagcccccacgacctgcgg

SEQ ID NO: 11428 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtggtgagctccgcgagcaccaaggggccctccgtcttcccccacgacctccgg

SEQ ID NO: 11429 - RNA, 426 nt, synthetic construct
  misc_feature 1..426: note = derived and/or modified sequence opt1 from anti-HIV-1_HeavyChain
  source 1..426: mol_type = other RNA
caggtgcagctggtccagagcggcgccgaggtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctccgccagcaccaagggcccctccgtgttcccccagatctgcgtg

SEQ ID NO: 11430 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctggatgaagacggtgagcgggaccgtcaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagcacgaaggcgcaccggtccagccccaccaccctgcgc

SEQ ID NO: 11431 - RNA, 423 nt, synthetic construct
  misc_feature 1..423: note = derived and/or modified sequence opt1 from anti-HIV-1_HeavyChain
  source 1..423: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgtcttcccccgcagcgcc

SEQ ID NO: 11432 - RNA, 423 nt, synthetic construct
  misc_feature 1..423: note = derived and/or modified sequence opt1 from anti-HIV-1_HeavyChain
  source 1..423: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggccaccagatcagcgaccgcgtctccctgagccgggaccgcgacctctccaccgcctacatggacatccgggggctgacccaggacgacaccgccacgtacttctgcgcccgccagaagttcgcgagccggtactccggcgaccaggggagctacttcgacctgtggggccgcgggaccctcatcgtggtgtccagcgcctccaccaagggccccagcgtcttcccccacgacctgcgg

SEQ ID NO: 11433 - RNA, 423 nt, synthetic construct
  misc_feature 1..423: note = derived and/or modified sequence opt1 from anti-HIV-1_HeavyChain
  source 1..423: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcacccgcgcccaccggtccagcccccgctccgcc

SEQ ID NO: 11434 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccaccggatcagcctgacccgcgaccgggacctcttcaccgcccacatggacatccgcgggctgacccagggcgacacggccacctacttctgcgcccggcagaagttcgagtcccgctacaccgggggccaggggtggtacttcgacctgtggggccggggcacccacatcgtcgtgagctccgcgagcacgaaggggccctccgtgttcccccacgacctccgc

SEQ ID NO: 11435 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagcacgaagggcccctccgtcttccccaccatctacgtg

SEQ ID NO: 11436 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctccgccagcaccaagggcccctccgtgttcccccacgacctgcgc

SEQ ID NO: 11437 - RNA, 423 nt, synthetic construct
  misc_feature 1..423: note = derived and/or modified sequence opt1 from anti-HIV-1_HeavyChain
  source 1..423: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgtcttccccacgatctgc

SEQ ID NO: 11438 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctctccaccgcccacatggacatccgggggctgacgcaggacgacaccgccacctacttctgcgcccgccagaagttcgcgcggggcgaccaggggtggttcttcgacctgtggggccgcgggaccctcatcgtggtgagctccgccctgcaccagggccccatcggcctgcccccgcggagcacg

SEQ ID NO: 11439 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagcgcctccaccaagggccccagcgtgctgcccccgcggtccgcc

SEQ ID NO: 11440 - RNA, 423 nt, synthetic construct
  misc_feature 1..423: note = derived and/or modified sequence opt1 from anti-HIV-1_HeavyChain
  source 1..423: mol_type = other RNA
caggtgcagctggtccagagcggcgccgaggtgaagaagcccggggcctccgtgaagatcagctgcaaggcgtccggctacaccttcatccgccacgggatccactggctccggcaggtccccggccagcgccccgagtggatggggtggatccggcccaagaccggcgcccgcaaccaggcccggcagttccagccccgcatcagcctggcccgggaccgcgccctgtccacggcgtacctcgacctgaacagcctgacctccgccgacagcggcacctacttctgcgcccggcagaccttcaagccggacttctacttcgccgaccaggggtggtccttcaacctctggggccgcggggcgcacttcatcgtgagctccgccctgcaccagggccccatcgggctgccgccccggagcacg

SEQ ID NO: 11441 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccaggggctggagtggatcggctgggtgaagatcgtcagcgggacggtgaacttcgcctccctggacttccggaaccgcatcagcctctcccgggaccgcgacctgagcaccgcctacatggacatccggggcctgacccaggacgacaccgccacgtacttctgcgcccgccagaagttcgcgtcccggtacagcggcgaccaggggtcctacttcgacctctggggccgcgggaccctgatcgtggtcagctccgccagcaccaagggcccctccgtgttcccccacgacctgcgg

SEQ ID NO: 11442 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacctctgcgcccgccagaagttcgagtcccggtacaccgggggccaggggtggtacttcgacctgtggggccgcggcacgcacatcgtcgtgagctccgcgagcaccaaggggccctccgtgttccccaccatctgcgtc

SEQ ID NO: 11443 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgacaccacggagctcatctactgggtgcggcaggcgccggggcagggcctggagtggatcgggtgggtcaagatcgtgtccggcaccgtgaacttcgccagcctggacttccgcaaccggatctccctcagccgcgaccgggacctgtccaccgcctacatggacatccgcggcctgacccaggacgacacggccacctacttctgcgcccggcagaagttcgcgagccgctactccggggaccagggcagctacttcgacctctgggggcggggcaccctgatcgtcgtgtccagcgcctccaccaaggggcccagcgtgttcccccagatctgcgtc

SEQ ID NO: 11444 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtcgtgagctccgcgagcaccaaggggccctccgtgttccccaccatctgcgtc

SEQ ID NO: 11445 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtccctgtacagcgacgaccaggggtcctacttcgacctctggggccgcgggaccctgatcatcgtgagctccgcgagcaccaagggcccctccgtgttccccacgatctgcgtc

SEQ ID NO: 11446 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggcacccacatcgtggtgtccagcgcgtccacgaaggggcccagcgtcttcccccacgacctccgg

SEQ ID NO: 11447 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgtcttccccacgatctgcgtg

SEQ ID NO: 11448 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccaggacgacaccgccacctacttctgcgcccgccagaagttcgcctcccggtacagcggcgaccaggggtcctacttcgacctctggggccgcgggacgctgatcgtggtgagctccgcgagcaccaagggcccctccgtcttccccaccatctgcgtg

SEQ ID NO: 11449 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggccaccgctccagccccacgatctgcgtc

SEQ ID NO: 11450 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccgggatgaagaagcccggcgcgagcatgaccgtctcctgcaagaccgccgacgaggacgtgttcgacgccgcctacatgcactgggtgcgccaggccccggggcagacgttcgagtggctgggctggatgaagcccgtcaccggggcggtgaactacgcccggaagttccagggccgcgtgagcttctaccggacccgcgagctcggcatcgcctacatggacctgcggaacctgcgcttcgacgacaccgccgtctacttctgcgcgcggaagacggccggggacgtgtccggcgacaagcgcgggttcttcttcgacctctggggccgggggagccgcgtgatcgtctccagcgcctccaccaagggccccagcgtgttccccaccatctacgtg

SEQ ID NO: 11451 - RNA, 423 nt, synthetic construct
  misc_feature 1..423: note = derived and/or modified sequence opt1 from anti-HIV-1_HeavyChain
  source 1..423: mol_type = other RNA
cagagccacctggagcagtccggcagcgccatgaagaagcccggggcctccgtgcgcgtcagctgctggacctccgaggacatcttcgacaccacggagctctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctccgccagcaccaagggcccctccgtgttcccccacgacctgcgc

SEQ ID NO: 11452 - RNA, 423 nt, synthetic construct
  misc_feature 1..423: note = derived and/or modified sequence opt1 from anti-HIV-1_HeavyChain
  source 1..423: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcccgccagttccagggccgggtgtccttctaccgcacccgggagctgggcatcgcctacatggacctccgcgacctgaagttcgacgacaccgccgtctacttctgcgcccggaagacgaagggggacgtgagcggcgacgaccgcgggttcttcttcgacctgtggggccgggggacccgcgtgatcgtctccagcgcgtccaccaagggccccagcgtgttcccccacgaccccgcc

SEQ ID NO: 11453 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtcccgctacaccgggggccaggggtggtacttcgacctgtggggccggggcacccacatcgtggtgagctccgcgagcacgaaggggccctccgtcttccccaccatctgcgtg

SEQ ID NO: 11454 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcagcgcgtctccctgacccgggaccgcgacctcagcaccgcccacatggacatccgggggctgacccaggacgacacggccacctacttctgcgcccgccagaagttcgagtccctgtacagcgacgaccagggctcctacttcgacctctgggggcggggcaccctgatcatcgtgagctccgcgagcaccaaggggccctccgtgttccccacgatctgcgtc

SEQ ID NO: 11455 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcgcctccggcgtgaagcgccccggggcgagcgtccgggtgtcctgctggaccagcgaggacatcttcgagcgcaccgagctcatctactgggtgcggcaggccccgggccaggggctggagtggatcggctgggtcaagacggtgtccggggccgtgaacttcggcagccaggacttccgcgaccggttctccctgacccgcgaccgggacctcttcaccgcccacatggacatccgcggcctgacccagggggacacggccacctacttctgcgcgcggcagaagttcgccagccgctactccggcgaccaggggagctacttcgacctgtggggccgggggaccctcatcgtcgtgtccagcgcctccaccaagggccccagcgtgttccccacgatctgcgtc

SEQ ID NO: 11456 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgagagccggtacaccggcgggcagggctggtacttcgacctgtgggggcgcggcacccacatcgtggtgtccagcgcctccaccaagggcccgagcgtcttccccacgatctgcgtg

SEQ ID NO: 11457 - RNA, 423 nt, synthetic construct
  misc_feature 1..423: note = derived and/or modified sequence opt1 from anti-HIV-1_HeavyChain
  source 1..423: mol_type = other RNA
caggtgcacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttcctccaggaccaggggatccggatcgcctacatggacctgcgcgacctgaagttcgacgacaccgccgtgtacttctgcgcccggaagaccaagggcgacgtctccggggacgaccgcggcttcttcttcgacctctgggggcggggcacgcgcgtgatcgtgagctccagcctgcaccagggccccatcgggctgcccccgcggtccgcg

SEQ ID NO: 11458 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccaccggatcagcctgacccgcgaccgggacctcttcaccgcccacatggacatccgcgggctgacccagggcgacacggccacctacttctgcgcccggcagaagttcgagtcccgctacaccgggggccaggggtggtacttcgacctgtggggccggggcacccacatcgtcgtgagctccgcgagcacgaaggggccctccgtgttccccaccatctacgtc

SEQ ID NO: 11459 - RNA, 426 nt, synthetic construct
  misc_feature 1..426: note = derived and/or modified sequence opt1 from anti-HIV-1_HeavyChain
  source 1..426: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaacttccagggccgcgtcagcttctaccggacccgcgagctggggatcgcctacatggacctgcggaacctccgcttcgacgacaccgccgtgtacttctgcgcccggaagacgaagggcgacgtgtccggggacgaccgcggcttcttcttcgacctgtgggggcggggcacccgcgtcatcgtgagctccggcctgcaccagcgggcgcaccgcagctcccccaccatctgcgtg

SEQ ID NO: 11460 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctccgccagcaccaagggcccctccgtgttccccacgatctgcgtg

SEQ ID NO: 11461 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgtcggggtgaagaagcccggcgccagcgtgaccctgtcctgcaagaccgcggacgaggacgtcttcgacgccgcctacatgcactgggtgcgccaggccccggggcccgacctcgagtggctgggctggatgaagcccgtgacgggggccgtcaactacgcgcggaagttccagggccgcgtgagcttctaccggacccgcgagctgggcatcgcctacatggacctccggaacctgcgcttcgacgacaccgccgtgtacttctgcgcccggaagaccgcgggggacgtctccggcgacaagcgcgggttcttcttcgacctgtggggccgggggagccgcgtgatcgtgtccagcgcctccacgaagggccccagcgtcttcccgaccatctgcgtg

SEQ ID NO: 11462 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgtcttcccccacgacctgcgc

SEQ ID NO: 11463 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgacgggcgccgtgaacttcggctccctcgacttccggcaccgcatcagcctgacccgggaccgcgacctgttcaccgcccacatggacatccgggggctcacccagggcgacacggccacctacttctgcgcgcgccagaagttcgagtcccggtacaccgggggccaggggtggtacttcgacctgtggggccgcggcacccacatcgtcgtgagctccgccagcacgaaggggccgtccgtgttcccccacgacctgcgg

SEQ ID NO: 11464 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagcggatcgggtgggtcaagacggtgaccggcgccgtgaacttcggctccctggacttccgccaccggatcagcctcacccgcgaccgggacctgttcaccgcccacatggacatccgcgggctgacgcagggcgacaccgccacctacttctgcgcccggcagaagttcgagtcccgctacaccgggggccaggggtggtacttcgacctctggggccggggcacgcacatcgtcgtgagctccgcgagcaccaaggggccctccgtgttccccaccatctgcgtc

SEQ ID NO: 11465 - RNA, 423 nt, synthetic construct
  misc_feature 1..423: note = derived and/or modified sequence opt1 from anti-HIV-1_HeavyChain
  source 1..423: mol_type = other RNA
gaggtgtacatggagcgcggccgcgggggcgtcaagaagcccggggccagcgccaccctgtcctgcaagaccgcggacgaggacgtgttcgacgccgcctacatgcactgggtgcggcaggccccgggccagacgttcgagtggctcgggtggatgaagcccgtcaccggcgccgtgagctacgcgcggaagttccagggccgcgtgtccttctacatgacccgggagctggggatggcctacatggacctgcgcaacctccggttcgacgacaccgccgtctacttctgcgcccgcaagacggcgggcgacgtgagcggggacaaccggggctacttcttcgacctgtgggggcgcggctcccgggtgatcgtcagctccgccagcaccaagggcccctccgtgttcccccacgacctgcgc

SEQ ID NO: 11466 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgcgcgcgtctcctgctggagctccgaggacatcttcgagcggatcgagctcatccactgggtgcgccaggccccggggcagggcctggagtggatcgggtgggtgaagaccgtcgccggcgccgtgaacttcggcagcctggacttccggcaccgcatctccctcacccgggaccgcgacctgttcacggcccacatggacatccgggggctgacccagggcgacaccgcgacctacttctgcgcccgccagaagttcgagagccggtacaccgggggccaggggtggtacttcgacctctggggccgcggcacgcacatcgtggtctccagcgcctccaccaaggggcccagcgtgttcccccacgacctgcgg

SEQ ID NO: 11467 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctccgcgagcaccaagggcccctccgtcttccccaccatctacgtg

SEQ ID NO: 11468 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaacggcatcagcctctcccgggaccgcgacctgagcaccgcctacatggacatccggggcctgacccaggacgacacggccacctacttctgcgcccgccagaagttcgcgtcccggtacagcggggaccagggctcctacttcgacctctgggggcgcggcaccctgatcgtggtcagctccgccagcaccaaggggccctccgtgttcccccacgacctgcgg

SEQ ID NO: 11469 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcgtggtcagctccgccagcaccaagggcccctccgtgttcccccacgacctgcgc

SEQ ID NO: 11470 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcggggacatcctccggaagtccgagctgatccactgggtgcgccaggcgccgggccaggggctggagtggatcggctgggtcaagaccgtgacgggcgccgtgaacttcgggagcctcgacttccggcaccgcatctccctgacccgggaccgcgacctgttcaccgcccacatggacatccggggcctcacccagggggacacggccacctacttctgcgcccgccagaagttcgagagccggtacaccggcgggcagggctggtacttcgacctgtggggccgcgggacccacatcgtcgtgtccagcgcgtccacgaagggccccagcgtgttcccccacgacctgcgg

SEQ ID NO: 11471 - RNA, 426 nt, synthetic construct
  misc_feature 1..426: note = derived and/or modified sequence opt1 from anti-HIV-1_HeavyChain
  source 1..426: mol_type = other RNA
caggtgcacctggagcagagcggctccggggtcaagaagcccggcgccagcgtgcgcgtgtcctgctggagctccgaggacatcttcgagcggaccgagctcatccactgggtccgccaggccccggggcagggcctggagtggatcgggtgggtgaagaccgtgacgggcgcggtcaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtggtgtccagcgcctgcacgaaggggccctccgtcttcccccacgacctgcgg

SEQ ID NO: 11472 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagctggtccggcgtgaagaagcccggggccagcgtccgcgtgtcctgctggagctccgaggacatcttcgagcggaccgagctcatccactgggtgcgccaggcgccgggccaggggctggagtggatcggctgggtcaagaccgtgacgggggccgtgaacttcggcagcctggacttccggcaccgcatctccctcacccgggaccgcgacctgttcaccgcccacatggacatccggggcctgacccagggggacacggccacctacttctgcgcccgccagaagttcgagagccggtacaccggcgggcagggctggtacttcgacctctgggggcgcggcacccacatcgtcgtgtccagcgcgtccacgaagggccccagcgtgttcccccacgacctgcgg

SEQ ID NO: 11473 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggcccgagtggatcggctgggtgaagacggtcagcgggaccgtgaacttcggctccagcgacttccgcaaccggatctccctgacccgcgaccgggacctgagcaccgcccacatggacatccgcggcctcacgcaggacgacaccgccacctacttctgcgcccggcagaagttcgagtccctgtacagcgacgaccaggggtcctacttcgacctgtggggccgcgggaccctcatcatcgtgagctccgccagcacgaagggcccctccgtcttcccccacgacctgcgg

SEQ ID NO: 11474 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaaggggcccagcgtgttccccaccatcctgcgg

SEQ ID NO: 11475 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcgccgtgagctccgcgagcacgaagggcccctccgtcttcccccacgacctgcgg

SEQ ID NO: 11476 - RNA, 426 nt, synthetic construct
  misc_feature 1..426: note = derived and/or modified sequence opt1 from anti-HIV-1_HeavyChain
  source 1..426: mol_type = other RNA
cagagccacctgaagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagcacgaagggcccctccgtcttcccccacgacctgcgg

SEQ ID NO: 11477 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgagtgggtcaaggccgtgtccggggccgtgaactacggcagcctcgacttccggcaccgcgtctccctgacgcgggaccgcgacctgttcaccgcccacatggacatccggggcctcacccaggacgacaccgccacgtacttctgcgcgcgccagaagttcgagagccggtacaccgggggccaggggtggtacttcgacctgtggggccgcgggacccacatcgtggtgtccagcgcctccaccaagggcccgagcgtcttcccccacgacctgcgg

SEQ ID NO: 11478 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgagtcccgctacagcggcgaccaggggtcctacttcgacctctggggccgggggaccctgatcatcgtgagctccgcgagcaccaagggcccctccgtcttcccccacgacctgcgc

SEQ ID NO: 11479 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagcctggacttccgcaaccggatctccctcagccgcgaccgggacctgtccaccgcctacatggacatccgcgggctgacccaggacgacaccgccacgtacttctgcgcccggcagaagttcgcgagccgctactccggcgaccaggggagctacttcgacctctggggccgggggaccctgatcgtcgtgtccagcgcctccaccaagggccccagcgtgttcccccacgacctgcgc

SEQ ID NO: 11480 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcagcgcgtctccctgagccgggaccgcgacctctccaccgcccacatggacatccgggggctgacccaggacgacaccgccacgtacttctgcgcccgccagaagttcgcgagccggtactccggcgaccaggggagctacttcgacctgtggggccgcgggaccctcatcatcgtgtccagcgcctccaccaagggccccagcgtgttcccccacgacctgcgg

SEQ ID NO: 11481 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagcacgaagggcccctccgtcttcccccacgacctgcgg

SEQ ID NO: 11482 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcggggcctggagtggatcgggtgggtcaagacggtgtccggcaccgtgaacttcggcagctccgacttccgcaaccggatcagcctgacccgcgaccgggacctctccaccgcccacatggacatccgcgggctgacgcaggacgacaccgccacctacttctgcgcccggcagaagttcgagagcctgtactccgacgaccagggcagctacttcgacctctgggggcgcggcaccctgatcatcgtctccagcgcctccacgaaggggcccagcgtgttcccccacgacctgcgg

SEQ ID NO: 11483 - RNA, 426 nt, synthetic construct
  misc_feature 1..426: note = derived and/or modified sequence opt1 from anti-HIV-1_HeavyChain
  source 1..426: mol_type = other RNA
caggtgcacctggagcagagcggctccggggtcaagaagcccggcgccagcgtgcgcgtgtcctgctggagctccgaggacatcttcgagcggaccgagctcatccactgggtccgccaggccccggggcagggcctggagtggatcgggtgggtgaagaccgtgacgggcgcggtcaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtggtgtccagcgcctccacgaaggggcccagcgtcttcccccacgacctgcgg

SEQ ID NO: 11484 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctccgcgagcaccaagggcccctccgtcttcccccacgacctgcgg

SEQ ID NO: 11485 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcgtggcctacatggacctgcgcaacctccggttcgacgacaccgccgtgtacttctgcgcgcgcaagacggccggggacgtcagcggcgacaaccgggggtacttcttcgacctgtggggccgcgggtcccgggtgatcgtgagctccgccagcaccaagggcccctccgtcttcccccacgacctgcgc

SEQ ID NO: 11486 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccggaacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctccgcgagcaccaagggcccctccgtcttcccccacgacctgcgg

SEQ ID NO: 11487 - RNA, 423 nt, synthetic construct
  misc_feature 1..423: note = derived and/or modified sequence opt1 from anti-HIV-1_HeavyChain
  source 1..423: mol_type = other RNA
caggtgcagctggtccagagcggcgccgaggtgaagaagcccggggcctccgtgaccctcagctgcaagaccgcggacgaggacgtcttcgacgccgcctacatgcactgggtgcgccaggccccgggccagacgttcgagtggctggggtggatgaagcccgtgaccggcgccgtctcctacgcgcggaagttccaggggcgcgtgagcttctacatgacccgggagctgggcatggcctacatggacctccgcaacctgcggttcgacgacaccgccgtgtacttctgcgcccgcaagacggcgggcgacgtctccggggacaaccggggctacttcttcgacctgtgggggcgcggcagccgggtgatcgtgtccagcgcctccaccaaggggcccagcgtcttccccaccatctacgtg

SEQ ID NO: 11488 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcgtgcactgggtccgccaggcgccggggcagggcctggagtggatcgggtgggtgaagacggtgaccggcgccgtcaacttcggctcccccaacttccggcagcgcgtgagcctgacccgggaccgcgacctcttcaccgcccacatggacatccgggggctgacgcaggacgacaccgccacctacttctgcgcccgccagaagttcgcgtcccggtacagcggcgaccaggggtcctacttcgacctgtggggccgcgggaccctcatcgtggtcagctccgccagcacgaagggcccctccgtgttcccccacgacctgcgg

SEQ ID NO: 11489 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggccccctggggctcccccacgacctgcgc

SEQ ID NO: 11490 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcctcccggtacagcggcgaccaggggtcctacttcgacctgtggggccgcgggaccctgatcgtggtgagctccgccagcaccaagggcccgtccgtcttcccccacgacctccgg

SEQ ID NO: 11491 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatctactgggtgcgccaggcgccggggcagggcctggagtggatcgggtgggtcaagatcgtgtccggcacggtgaacttcgccagcctggacttccggaaccgcatctccctcagccgggaccgcgacctgtccaccgcccacatggacatccggggcctgacccaggacgacaccgccacgtacttctgcgcccgccagaagttcgcgagccggtactccggggaccagggcagctacttcgacctctgggggcgcggcaccctgatcatcgtctccagcgcctccaccaaggggcccagcgtgttcccccacgacctgcgg

SEQ ID NO: 11492 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggaaccgcatcagcctgacccgggaccgcgacctctccaccgcccacatggacatccgggggctgacgcaggacgacaccgccacctacttctgcgcccgccagaagttcgagagcctgtactccgacgaccagggcagctacttcgacctctgggggcggggcaccctgatcatcgtctccagcgcgtccacgaaggggcccagcgtgttcccccacgacctgcgc

SEQ ID NO: 11493 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtccctgtacagcgacgaccaggggtcctacttcgacctctggggccgcgggaccctgatcatcgtgagctccgcgagcaccaagggcccctccgtgttcccccacgacctgcgg

SEQ ID NO: 11494 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccagcgacttccggaaccgcatctccctgacccgggaccgcgacctcagcaccgcccacatggacatccgggggctgacgcaggacgacaccgccacctacttctgcgcccgccagaagttcgagtccctgtacagcgacgaccagggctcctacttcgacctctgggggcggggcaccctgatcatcgtcagctccgcgagcacgaaggggccctccgtgttcccccacgacctgcgc

SEQ ID NO: 11495 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgcgcgcgtgagctgctggacctccgaggacatcttcgacaccacggagctcatctactgggtccggcaggccccgggccaggggctggagtggatcggctgggtgaagatcgtgagcgggaccgtcaacttcgcctccctggacttccgcaaccggatcagcctctcccgcgaccgggacctgagcaccgcccacatggacatccgcggcctgacccaggacgacacggccacctacttctgcgcgcggcagaagttcgcctcccgctacagcggcgaccaggggtcctacttcgacctctggggccgggggacccacatcgtggtgagctccgccagcaccaagggcccctccgtcttcccccacgacctgcgc

SEQ ID NO: 11496 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgagagccggtacaccggcgggcagggctggtacttcgacctgtgggggcgcggcacccacatcgtggtgtccagcgcctccaccaagggcccgagcgtcttcccccacgacctgcgg

SEQ ID NO: 11497 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgagtcccggtacaccggcgggcagggctggtacttcgacctgtgggggcgcggcacccacatcgtggtgagctccgccagcaccaagggcccgtccgtcttcccccacgacctgcgg

SEQ ID NO: 11498 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgcctcccgctacagcggggaccagggctcctacttcgacctgtgggggcggggcaccctcatcatcgtgagctccgcgagcacgaaggggccctccgtcttcccccacgacctgcgc

SEQ ID NO: 11499 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccgcatggacatccggggcctgacgcaggacgacaccgccacctacttctgcgcccgccagaagttcgagtccctgtacagcgacgaccaggggtcctacttcgacctctggggccgggggaccctgatcatcgtgagctccgccagcacgaagggcccctccgtcttccccaccgacctgcgc

SEQ ID NO: 11500 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccaggacgacacggccacctacttctgcgcccggcagaagttcgcgtcccgctacagcggcgaccaggggtcctacttcgacctgtggggccgggggaccctcatcgtggtgagctccgccagcaccaagggcccctccgtcttcccccacgacctgcgc

SEQ ID NO: 11501 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagcacgaacggccccatcgggctgccccacgacctccgg

SEQ ID NO: 11502 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtcccgctacaccgggggccaggggtggtacttcgacctgtggggccggggcacccacatcgtggtgagctccgcgagcacgaaggggccctccgtcttcccccacgacctccgc

SEQ ID NO: 11503 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcaggacgacaccgccacctacttctgcgcccgccagaagttcgcgtcccggtacagcggcgaccaggggtcctacttcgacctgtggggccgcgggaccctcatcgtggtgagctccgccagcacgaagggcccctccgtcttcccccacgacctgcgg

SEQ ID NO: 11504 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccggcctcatctactgggtgcgccaggcgccggggcggggcctggagtggatcgggtgggtgaagacggtcagcggcaccgtgaacttcggctccagcgacttccgcaaccggatctccctgacccgcgaccgggacctcagcaccgcccacatggacatccgcgggctgacgcaggacgacaccgccacctacttctgcgcccggcagaagttcgagtccctgtacagcgacgaccagggctcctacttcgacctctgggggcgcggcaccctgatcatcgtgagctccgccagcacgaaggggccctccgtcttcccccacgacctgcgg

SEQ ID NO: 11505 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccagatcttccggcaccgcatcagcctgacccgggaccgcgacctcttcaccgcccacatggacatccgggggctgacgcagggcgacaccgccacctacttctgcgcccgccagaagttcgagtcccggtacaccgggggccaggggtggtacttcgacctgtggggccgcggcacgcacatcgtcgtgagctccgcgagcaccaaggggccctccgtgttcccccacgacctccgg

SEQ ID NO: 11506 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatccactgggtgcggcaggcgccgggccaggggctggagtggatcggctgggtgaagaccgtcaccggggccgtgaacttcggcagcctggacttccgccaccggatctccctcacccgcgaccgggacctgttcacggcccacatggacatccgcggcctgacccagggggacaccgccacctacttctgcgcccggcagaagttcgagagccgctacacgggcgggcagggctggtacttcgacctctgggggcggggcacccacatcgtggtctccagcgcgtccaccaagggccccagcgtgttcccccacgacctgcgc

SEQ ID NO: 11507 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgaggtgaagaagcccggggcctccgtccgcgtgagctgctggacctccgaggacatcttcgagcggaccgagctcatctactgggtgcgccaggccccgggccgggggctggagtggatcggctgggtcaagacggtgagcgggaccgtgaacttcggctccagcgacttccgcaaccggatctccctgacccgcgaccgggacctcagcaccgcgcacatggacatccgcggcctgacgcaggacgacaccgccacctacttctgcgcccggcagaagttcgagtccctgtacagcgacgaccaggggtcctacttcgacctctggggccgcgggaccctgatcatcgtcagctccgccagcacgaagggcccctccgtgttcccccacgacctgcgg

SEQ ID NO: 11508 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgggggcgtcaagaagcccggggccagcgtgaccctgtcctgcaagaccgcggacgaggacatcttcgacgccgcctacatgcactgggtgcgccaggccccgggccagacgttcgagtggctcgggtggatgaagcccgtcaccggcgccgtgaactacgcgcggcagttccagggccgcgtgagcttctaccggacccgcgagctggggatcgcctacatggacctgcgggacctcaagttcgacgacaccgccgtctacttctgcgcccgcaagacgaagggcgacgtgtccggggacgaccggggcttcttcttcgacctgtgggggcgcggcacccgggtgatcgtcagctccgcgagcaccaagggcccctccgtgttcccccacgacctgcgc

SEQ ID NO: 11509 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgaggtgaagaagcccggggcctccgtccgcgtgagctgctggacctccgaggacatcttcgacaccacggagctcatctactgggtgcggcaggccccgggccaggggctggagtggatcggctgggtcaagatcgtgagcgggaccgtgaacttcgcgtccctggacttccgcaaccggatcagcctctcccgcgaccgggacctgagcaccgcccacatggacatccgcggcctgacccaggacgacacggccacctacttctgcgcccggcagaagttcgcctcccgctacagcggcgaccaggggtcctacttcgacctctggggccgggggaccctgatcatcgtcagctccgcgagcaccaagggcccctccgtgttcccccacgacctgcgc

SEQ ID NO: 11510 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgagccgggaccgcgacctctccaccgcctacatggacatccgggggctgacccaggacgacaccgccacgtacttctgcgcccgccagaagttcgcgagccggtactccggcgaccaggggagctacttcgacctgtggggccgcgggaccctcatcgtggtgtccagcgcctccaccaagggccccagcgtcttcccccacgacctgcgg

SEQ ID NO: 11511 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccgccaaggggcccagcgtgttcccccacgacctgcgg

SEQ ID NO: 11512 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgcccggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcgtggtcagctccgccagcacgaagggcccctccgtgttcccgccccggagcgcg

SEQ ID NO: 11513 - RNA, 426 nt, synthetic construct
  misc_feature 1..426: note = derived and/or modified sequence opt1 from anti-HIV-1_HeavyChain
  source 1..426: mol_type = other RNA
caggtgcacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacgaagggcgacgtgtccggggacgaccgcggcttcttcttcgacctgtgggggcggggcacccgcgtcatcgtgagctccgcgagcaccaagggccccctgcggtccttcccccgccggagcgcc

SEQ ID NO: 11514 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaaggggcccagcgtgttccccaccatctacgtc

SEQ ID NO: 11515 - RNA, 426 nt, synthetic construct
  misc_feature 1..426: note = derived and/or modified sequence opt1 from anti-HIV-1_HeavyChain
  source 1..426: mol_type = other RNA
gagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgtcttcccccacgacctgcgc

SEQ ID NO: 11516 - RNA, 429 nt, synthetic construct
  misc_feature 1..429: note = derived and/or modified sequence opt1 from anti-HIV-1_HeavyChain
  source 1..429: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccaggacgacaccgccacgtacttctgcgcccgccagaagttcgcgagccggtactccggcgaccaggggagctacttcgacctgtggggccgcgggaccctcatcgtggtgtccagcgcctccaccaagggccccagcggcctgcccccgcggtcctgcgtc

SEQ ID NO: 11517 - RNA, 423 nt, synthetic construct
  misc_feature 1..423: note = derived and/or modified sequence opt1 from anti-HIV-1_HeavyChain
  source 1..423: mol_type = other RNA
caggtgcacctggtccagagcggcgccgaggtgaagaagcccggggcctccgtgaaggtcagctgcaaggcgtccggctacaccttcaccacgagcgggatccactggctccgccaggtgccgggccagcggcccgagtggatggggtggatccgccccaagaccggcgcccggaaccaggcccgccagttccagccccggatctccctgacccgcgaccgggccctgagcaccgcctacctcgacctgaactccctgacgagcgcggactccggcacctacttctgcgcccgccagaccttcaagccggacttctacttcgccgaccaggggtggagcttcaacctctggggccgcggggcccacttcatcgtgtccagcgcgtccaccaagggccccagcgtcttcccccacgacctgcgg

SEQ ID NO: 11518 - RNA, 429 nt, synthetic construct
  misc_feature 1..429: note = derived and/or modified sequence opt1 from anti-HIV-1_HeavyChain
  source 1..429: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgcccgggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgcaggggcccatcggcctgccgccccggctgtgcgtg

SEQ ID NO: 11519 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgcccggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggccccatcgggctgccgccccgctccacg

SEQ ID NO: 11520 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagcctggacttccgccaccggatctccctcacccgcgaccgggacctgttcaccgcccacatggacatccgcgggctgacccagggcgacacggccacctacttctgcgcccggcagaagttcgagagccgctacaccgggggccaggggtggtacttcgacctctggggccggggcacccacatcgtcgtgtccagcgcgtccacgaaggggcccagcgtgttccccaccatctgcgtc

SEQ ID NO: 11521 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttcgagagccggtacaccgggggccaggggtggtacttcgacctgtggggccgcggcacccacatcgtggtgtccagcgccctgcaccaggggcccatcggcctcccgccccggtccacc

SEQ ID NO: 11522 - RNA, 429 nt, synthetic construct
  misc_feature 1..429: note = derived and/or modified sequence opt1 from anti-HIV-1_HeavyChain
  source 1..429: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccgggtgagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtcgtgagctccgccctgcaccagggccccatcgggcccagccccaccatcctccgc

SEQ ID NO: 11523 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgtcttccccacgatctacgtg

SEQ ID NO: 11524 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgagtcccgctacaccggcgggcagggctggtacttcgacctctgggggcggggcacccacatcgtggtcagctccgcgagcacgaaggggccctccgtgttccccaccatctgcgtg

SEQ ID NO: 11525 - RNA, 426 nt, synthetic construct
  misc_feature 1..426: note = derived and/or modified sequence opt1 from anti-HIV-1_HeavyChain
  source 1..426: mol_type = other RNA
caggtgcagctggtccagagcggcgccgaggtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgagtcccgctacaccggcgggcagggctggtacttcgacctctgggggcggggcacccacatcgtggtcagctccgcgagcacgaaggggccctccgtgttccccaccatctgcgtg

SEQ ID NO: 11526 - RNA, 426 nt, synthetic construct
  misc_feature 1..426: note = derived and/or modified sequence opt1 from anti-HIV-1_HeavyChain
  source 1..426: mol_type = other RNA
cgccggcacctggagcagagcggctccggggtgaagaagcccggcgccagcgtccgcgtgtcctgctggagctccgaggacatcttcgagcggaccgagctcatccactgggtgcgccaggccccggggcagggcctggagtggatcgggtgggtcaagaccgtgacgggcgcggtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcctccacgaaggggcccagcgtgttcccccacgacctgcgg

SEQ ID NO: 11527 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgagtcccgctacagcggcgaccaggggtcctacttcgacctctggggccgggggaccctgatcatcgtgagctccgcgagcaccaagggcccctccgtcttccccacgatctgcgtg

SEQ ID NO: 11528 - RNA, 429 nt, synthetic construct
  misc_feature 1..429: note = derived and/or modified sequence opt1 from anti-HIV-1_HeavyChain
  source 1..429: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtcgtgagctccgcgagcaccaaggggccccaccccgtgttcccccacgacctgccg

SEQ ID NO: 11529 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatctactgggtgcgccaggcgcccgggcagggcctggagtggatcgggtgggtcaagatcgtgtccggcacggtgaacttcgccagcctcgacttccggaaccgcatctccctgagccgggaccgcgacctgtccaccgcctacatggacatccggggcctcacccaggacgacaccgccacgtacttctgcgcccgccagaagttcgcgagccggtactccggggaccagggcagctacttcgacctgtgggggcgcggcaccctgatcgtcgtgtccagcgcctccaccaaggggccgagcgtgttccccaccatctacgtc

SEQ ID NO: 11530 - RNA, 429 nt, synthetic construct
  misc_feature 1..429: note = derived and/or modified sequence opt1 from anti-HIV-1_HeavyChain
  source 1..429: mol_type = other RNA
caggcccacctggagcagagcggctccggggtgaagaagcccggcgccagcgtccgcgtgtcctgctggaccagcgaggacatcttcgagcggaccgagctcatccactgggcgcgccaggcccccgggcagggcctggagtggatcgggtgggtgaagacggtcaccggcgccgtgaacttcggctccctggacttccggcaccgcatcagcctcacccgggaccgcgacctgttcaccgcccacatggacatccgggggctgacgcagggcgacaccgccacctacttctgcgcgcgccagaagttcgagtcccggtacaccgggggccaggggtggtacttcgacctctggggccgcggcacgcacatcgtggtcagctccgccagcaccaaggggcccctgggcctgccgccccggctctcccgc

SEQ ID NO: 11531 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgcccggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgtcccgctacagcggcgaccaggggtcctacttcgacctctggggccgggggaccctgatcatcgtgagctccgccagcaccaagggcccctccgggctgccgccccgcagcgcc

SEQ ID NO: 11532 - RNA, 426 nt, synthetic construct
  misc_feature 1..426: note = derived and/or modified sequence opt1 from anti-HIV-1_HeavyChain
  source 1..426: mol_type = other RNA
caggtgcagctggtccagagcggcgccgaggtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgcggcaggacgacaccgccacgtacttctgcgcccgccagaagttcgagtcccggtacagcggcgaccaggggtcctacttcgacctctggggccgcgggaccctgatcatcgtgagctccgcgagcaccaagggcccctccgtcttcccccacgacctgcgg

SEQ ID NO: 11533 - RNA, 426 nt, synthetic construct
  misc_feature 1..426: note = derived and/or modified sequence opt1 from anti-HIV-1_HeavyChain
  source 1..426: mol_type = other RNA
gaggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcacggtgaacttcgccagcctggacttccggaaccgcatctccctcagccgggaccgcgacctgtccaccgcctacatggacatccggggcctgacccaggacgacaccgccacgtacttctgcgcccgccagaagttcgcgagccggtactccggggaccagggcagctacttcgacctctgggggcgcggcaccctgatcgtcgtgtccagcgcctccaccaaggggcccagcgtgttcccccacgacctgcgg

SEQ ID NO: 11534 - RNA, 423 nt, synthetic construct
  misc_feature 1..423: note = derived and/or modified sequence opt1 from anti-HIV-1_HeavyChain
  source 1..423: mol_type = other RNA
caggtgcagctggtccagagcggcgccgaggtgaagaagcccggggcctccgtgaaggtcagctgccgcgcgtccggctacaccttcgggaaccacgccatcagctgggtgcggcaggccccgggccaggggctcgagtggatgggctggatccgccccaagaccggcgcccggaaccaggcccgccagttccagccccggatctccctgacgcgcgaccgggcgctgagcaccgcctacctcgacctgaactccctgaccagcgccgactccgggacctacttctgcgcccgccagacgttcaagcccgacttctacttcgcggaccagggctggagcttcaacctctgggggcggggcgcccacttcatcgtgtccagcgcctccaccaaggggccgagcgtcttcccccacgacctgcgc

SEQ ID NO: 11535 - RNA, 429 nt, synthetic construct
  misc_feature 1..429: note = derived and/or modified sequence opt1 from anti-HIV-1_HeavyChain
  source 1..429: mol_type = other RNA
cagggccacaacctggagcagagcgggtccgaggtgaagaagcccggcgccagcgtccgcgtgtcctgctggaccagcgaggacatcttcgagcggaccgagctcatccactgggtgcgccaggccccggggcagggcctggagtggatcgggtgggtcaagacggtgaccggcgcggtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtcgtgagctccgccagcaccaaggggccctccgtgttcccccacgacctgcgg

SEQ ID NO: 11536 - RNA, 426 nt, synthetic construct
  misc_feature 1..426: note = derived and/or modified sequence opt1 from anti-HIV-1_HeavyChain
  source 1..426: mol_type = other RNA
cccaccacctggaacaagagcggctccgacgtgaagaagccgggggccagcgtccgcgtgtcctgctggacgagcgaggacatcttcgagcggaccgagctgatccactgggtgcgccaggcccccggccaggggctcgagtggatcggctgggtcaagaccgtgaccggggcggtgaacttcggctcccccaacttccggcaccgcgtcagcctgacgcgggaccgcgacctgtccaccgcccacatggacatccggggcctcacccaggacgacaccgccacgtacttctgcgcccgccagaagttcgagagcctgtactccgacgaccaggggagctacttcgacctgtggggccgggggaccctcatcatcgtgtccagcgcctccaccaagggccccagcgtgttcccgcacgacctgcgc

SEQ ID NO: 11537 - RNA, 432 nt, synthetic construct
  misc_feature 1..432: note = derived and/or modified sequence opt1 from anti-HIV-1_HeavyChain
  source 1..432: mol_type = other RNA
cacgtgaccccctggaacgagtacgtcggccgcgccatgaagaagccggggcggagcgtgcgcgtgtcctgctggaccagcgaggacatcttcgacacgaccgagctgatctactgggtccggcaggcccccggccaggggctcgagtggatcggctgggtgaagatcgtgtccgggaccgtcaacttcgcgagcctggacttccgcaaccggatctccctgagccgcgaccgggacctctccaccgcctacatggacatccgcggcctgacgcaggacgacaccgccacctacttctgcgcccggcagaagttcgccagccgctactccggcgaccaggggagctacttcgacctgtggggccgggggaccctcatcgtggtgtccagcgcgtccacgaagggccccagcgtcttcccccacgacctgcgc

SEQ ID NO: 11538 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgcgccggcccggggcctccgtgaaggtcagctgcaaggcgtccggcttcagcttcctcgggcactacatccactgggtgcgccaggccccgggccaggggctggagtggatcggctgggtgaaggccgtctccggcgccgtgaactacgggagcctggacttccggcaccgcgtgtccctcacccgggaccgcgacctgagcaccgcccacatggacatccggggcctgacgcaggacgacaccgcgacctacttctgcgcccgccagaagttcgcccgcggggaccagggctggttcttcgacctctgggggcggggcaccctgatcgtcgtgtccagc

SEQ ID NO: 11539 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgaaggtcagctgcaaggcgtccggctacaccttcaccagctacgggatctcctgggtgcgccaggccccgggccaggggctcgagtggatcggctgggtgaagatcgtcagcggcgccgtgaacttcgggtcccccaacttccggcagcgcgtgagcctgacgcgggaccgcgacctgttcaccgcccacatggacatccggggcctcacccagggggacaccgccacgtacttctgcgcgcgccagaagttcgagcggggcgggcagggctggatcttcgacctgtggggccgcgggaccctgatcgccgtctccagc

SEQ ID NO: 11540 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcgaggccgaggtgaagaagcccggcgcctccgtgaagatcagctgcgcgacctccgggtacgccttcaccctctactacctgcactgggtccgccaggccccgggccaggggctggagtggatcggctgggtgaagacggtgaccggggccgtcaacttcggcagcgcctacttccggcaccgcgtgtccctcacccgggaccgcgacctgttcaccgcgcacatggacatccggggcctgacgcagggggacaccgccacctacttctgcgcccgccagaagttctacaagggcgggcagggctggtacttcgacctctgggggcggggcaccctgatcgtggtcagctcc

SEQ ID NO: 11541 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagaccgagctcatccactgggtgcggcaggcgccggggcagggcctggagtggatcgggtgggtcaagacggtgaccggcgccgtgaacttcggctcccccaacttccgccaccgggtcagcctgacccgcgaccgggacctcttcaccgcccacatggacatccgcgggctgacgcagggcgacaccgccacctacttctgcgcccggcagaagttcgagcgcgggggccaggggtggtacttcgacctgtggggccggggcaccctcatcgtggtgtccagc

SEQ ID NO: 11542 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtcccgctgacgcgcgaccgggacctgttcaccgcccacatggacatccgcgggctcacccaggacgacaccgccacgtacttctgcgcgcggcagaagttcgcccgcggcgaccaggggtggttcttcgacctgtggggccgggggaccctgatcgtggtgtccagc

SEQ ID NO: 11543 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccccggaggacatcttcgagcggaccgagctcatccactgggtgcgccaggcgcccgggcagggcctggagtggatcgggtgggtcaagatcgtgagcggcgccgtgaacttcggctcccccaacttccggcagcgcgtcagcctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgtccagc

SEQ ID NO: 11544 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccggggcgagcgtccgggtgtcctgctggaccagcgaggacatcttcgagggctccgagctcatccactgggtgcgccaggccccggggcagggcctggagtggatcgggtgggtcaagaccgtgacgggcgccgtgaacttcggcagcgcctacttccggcaccgcgtctccctgacccgggaccgcgacctcttcaccgcccacatggacatccgggggctgacccagggcgacacggcgacctacttctgcgcccgccagaagttctacaagggcgggcaggggtggtacttcgacctgtggggccggggcaccctcatcgtggtgagctcc

SEQ ID NO: 11545 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgagctcc

SEQ ID NO: 11546 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcgggcggagctcatccactgggtgcgccaggccccggggcagggcctggagtggatcgggtgggtcaagaccgtgaccggcgccgtgaacttcggcagccccaacttccggcagcgcgtctccctgacgcgggaccgcgacctcttcaccgcccacatggacatccgggggctgacccagggcgacaccgccacgtacttctgcgcgcgccagaagttcgagcgcgggggccaggggtggatcttcgacctgtggggccggggcaccctcatcgccgtgagctcc

SEQ ID NO: 11547 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtcgtgtccagc

SEQ ID NO: 11548 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagctcggcgccagcgtgcgcgtgtcctgctggaccagcgaggacatcttcgagcggaccgagctgatccactgggtccgccaggcccccgggcagggcctggagtggatcgggtgggtgaaggcggtgtccggcgccgtcaactacggcagcctcgacttccggcaccgcgtgtccctgacgcgggaccgcgacctgagcaccgcccacatggacatccgggggctcacccaggacgacaccgccacgtacttctgcgcccgccagaagttcgcgcggggcgaccaggggtggttcttcgacctgtggggccgcgggaccctgatcgtggtctccagc

SEQ ID NO: 11549 - RNA, 375 nt, synthetic construct
  misc_feature 1..375: note = derived and/or modified sequence opt1 from anti-HIV-1_HeavyChain
  source 1..375: mol_type = other RNA
caggcctacctggagcagagcggctccatcatgaagaagcccggggccagcgtgcgcgtctcctgctggaccagcgaggacatcttcgaccggaccgagctcatctactgggtgcgccaggcgccgggccaggggctggagtggatcggctgggtgaagatcgtctccggggccgtgaacttcggcagcctggacttccggaaccgcgtgtccctcacgcgggaccgcgacctgttcaccgcccacatggacatccggggcctgacccagggggacaccgccacgtacttctgcgcccgccagaagttcgagcggggcgggcagggctggtacttcgacctctgggggcgcggcaccctgatcgtcgtgagctcc

SEQ ID NO: 11550 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatcaactgggtgcgccaggcgccggggcagggcctggagtggatcgggtgggtcaaggccgtgtccggcgccgtgaactacggcagcctggacttccggcaccgcgtctccctcacgcgggaccgcgacctgagcaccgcccacatggacatccgggggctgacccaggacgacaccgccacgtacttctgcgcgcgccagaagttcgcccggggcgaccaggggtggttcttcgacctctggggccgcgggaccctgatcgtggtgtccagc

SEQ ID NO: 11551 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagcgcgggggccaggggtggtacttcgacctctggggccggggcaccctgatcgtcgtgagctcc

SEQ ID NO: 11552 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagatcgtgtccggcgcggtgaacttcggcagccccaacttccggcagcgcgtctccctgacccgggaccgcgacctcttcaccgcccacatggacatccgggggctgacccagggcgacacggccacctacttctgcgcccgccagaagttcgagcgcgggggccaggggtggatcttcgacctgtggggccggggcaccctcatcgccgtgagctcc

SEQ ID NO: 11553 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcggggacatcttcgagcggaccgagctgatccactgggtgcgccaggcgcccggccaggggctggagtggatcggctgggtcaaggccgtgtccggcgccgtgaactacgggagcctcgacttccggcaccgcgtctccctgacgcgggaccgcgacctgttcaccgcccacatggacatccggggcctcacccaggacgacaccgccacgtacttctgcgcgcgccagaagttcgcccgcggggaccagggctggttcttcgacctgtgggggcggggcaccctgatcgtggtgagctcc

SEQ ID NO: 11554 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacaccgacatccgggggctgacccagggcgacacggccacctacttctgcgcccgccagaagttcgagcgcgggggccaggggtggtacttcgacctgtggggccggggcaccctcatcgtggtgagctcc

SEQ ID NO: 11555 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgcctcgcgagcgaggacatcttcgagcggaccgagctgatccactgggtgcgccaggccccggggcagggcctggagtggatcgggtgggtcaagaccgtgacgggcgccgtgaacttcggctcccccaacttccggcaccgcgtcagcctcacccgggaccgcgacctgttcaccgcccacatggacatccgggggctgacccagggcgacacggccacctacttctgcgcgcgccagaagttcgagcgcgggggccaggggtggtacttcgacctctggggccggggcaccctgatcgtggtgtccagc

SEQ ID NO: 11556 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagcgccccggcgcgtccgtccgggtgagctgctggacctccgaggacatcttcgagaccacggagctcatccactgggtgcgccaggccccggggcagggcctggagtggatcgggtgggtcaagaccgtgagcggcgccgtgaacttcggctccctgaacttccggcaccgcgtcagcctcacccgggaccgcgacctgttcaccgcccacatggacatccgggggctgacgcagggcgacaccgccacctacttctgcgcgcgccagaagttcgcccgcggggaccagggctggttcttcgacctctgggggcggggcaccctgatcgtggtgtccagc

SEQ ID NO: 11557 - RNA, 375 nt, synthetic construct
  misc_feature 1..375: note = derived and/or modified sequence opt1 from anti-HIV-1_HeavyChain
  source 1..375: mol_type = other RNA
cgccacacctggaacaagagcggctccggggtgaagaagcccggcgccagcgtccgggtgtcctgctggaccagcgaggacatcttcgagaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgttcaccgcccacatggacatccgggggctcacgcagggcgacaccgccacctacttctgcgcccgccagaagttctacgccgggggccaggggtggtacttcgacctgtggggccggggcaccctgatcgtggtgtccagc

SEQ ID NO: 11558 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcgagtccggcagcggggtgaagaagccgggcgcctccgtccgcgtgagctgctggacctccgaggacatcttcgagcggacggagctgatccactgggtgcgccaggcccccgggcagggcctcgagtggatcggctgggtcaagatcgtgagcggggcggtgaacttcggctcccccaacttccggcagcgcgtcagcctgacccgggaccgcgacctgttcaccgcccacatggacatccgggggctcacccagggcgacacggccacctacttctgcgcccgccagaagttcgagcgcgggggccagggctggatcttcgacctgtgggggcggggcaccctgatcgccgtgtccagc

SEQ ID NO: 11559 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcaccgaggtgcagaagcccggggcctccgtgaaggtcagctgcaaggccttcggctactccttcaccgactactacgtgtactgggtgcgccaggcgccggggcagggcctcgagtacgtcgcctggatcaaccccagcaacgggtacacgaagtacgcccagaagttccaggactgggtgaccctgacccgggactccagcatcaacaccgcctacctgcagctcgcccgcgtgacgtccgacgacaccgcgatctactactgcgcccggcagaagttcgccagccgctactccggcgaccagggcagctacttcgacctgtgggggcggggcaccctgatcgtcgtgtccagc

SEQ ID NO: 11560 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgccgtgaagaagcccgggtccagcgtgaaggtctcctgcaaggcgagcggctacatcttcaccgggtactacatccactggatccgccaggccccgggccaggggctcgagtggatgggctggatcaacccctccaccggcgacacgaagttcgcccggcagttccaggggcgcgtgagcttctaccggacccgcgagctgggcatcgcctacatggacctgcgggacctcaagttcgacgacaccgccgtgtacttctgcgcgcgcaagaccaagggggacgtctccggcgacgaccgggggttcttcttcgacctgtggggccgcggcacgcgggtgatcgtgagctcc

SEQ ID NO: 11561 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccgggatgaagaagcccggcgcgagcatgaccgtctcctgcaagaccgccgacgaggacatcttcgacgccgcctacatgcactgggtgcgccaggccccggggcagacgttcgagtggctgggctggatgaagcccgtgaccggggcggtcaactacgcccggcagttccagggccgcgtgagcttctaccggacccgcgagctcggcatcgcctacatggacctgcgggacctgaagttcgacgacaccgccgtgtacttctgcgcgcgcaagacgaagggggacgtctccggcgacgaccgggggttcttcttcgacctctggggccgcgggacccgggtgatcgtgagctcc

SEQ ID NO: 11562 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcgggggcatgaagaagcccggggccagcatgaccgtctcctgcaagaccgcggacgaggacgtgttcgacgccgcctacatgcactgggtgcgccaggccccgggccagacgttcgagtggctggggtggatgaagcccgtcaccggcgccgtgaactacgcgcggaagttccagggccgcgtgagcttctaccggacccgcgagctcgggatcgcctacatggacctgcgggacctgaagttcgacgacaccgccgtctacttctgcgcccgcaagacgaagggcgacgtgtccggggacgaccggggcttcttcttcgacctctgggggcgcggcacccgggtgatcgtcagctcc

SEQ ID NO: 11563 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcgggggcatgaagaagcccggggccagcatgaccgtctcctgcaagaccgcggacgaggacgtgttcgacgccgcctacatgcactgggtgcgccaggccccgggccagacgttcgagtggctggggtggatgaagcccgtcaccggcgccgtgaactacgcgcggcagttccagggccgcgtgagcttctaccggacccgcgagctcgggatcgcctacatggacctgcgggacctgaagttcgacgacaccgccgtctacttctgcgcccgcaagacgaagggcgacgtgtccggggacgaccggggcttcttcttcgacctctgggggcgcggcacccgggtgatcgtcagctcc

SEQ ID NO: 11564 - RNA, 381 nt, synthetic construct
  misc_feature 1..381: note = derived and/or modified sequence opt1 from anti-HIV-1_HeavyChain
  source 1..381: mol_type = other RNA
caggtgcacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcccgggtcatcgtgagctcc

SEQ ID NO: 11565 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttctaccggacccgcgagctcgggatggcctacatggacctgcggaacctgcgcttcgacgacaccgccgtgtacttctgcgcccggaagacggcgggcgacgtctccggggacaaccgcggctacttcttcgacctctgggggcggggcagccgcgtgatcgtgtccagc

SEQ ID NO: 11566 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcctgggtcatcgtgagctcc

SEQ ID NO: 11567 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaccctcagctgcaagaccgcggacgaggacgtcttcgacgccgcctacatgcactgggtgcgccaggccccgggccagacgttcgagtggctggggtggatgaagcccgtgaccggcgccgtcaactacgcgcggaagttccaggggcgcgtgtccttctaccggacccgcgagctgggcatcgcctacatggacctccggaacctgcgcttcgacgacaccgccgtgtacttctgcgcccggaagacggcgggcgacgtcagcggggacaagcgcggcttcttcttcgacctgtgggggcggggctcccgcgtgatcgtgagctcc

SEQ ID NO: 11568 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccggggcctgagcaccgcctacatggacatccgcggcctgacccaggacgacacggccacctacttctgcgcccggcagaagttcgcgtcccgctacagcggggaccagggctcctacttcgacctctgggggcggggcaccctgatcgtggtcagctcc

SEQ ID NO: 11569 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctggatcaagctggtcagcggggccgtgaacttcggctccgtggacttccgcgaccgggtcagcctcacccgcgaccgggacctgttcacggcccacatggacatccgcggcctgacccagggggacaccgccacctacttctgcgcgcggcagaagttcgagtcccgctacacgggcgggcagggctggtacttcgacctctgggggcggggcacccacatcgtggtgagctcc

SEQ ID NO: 11570 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaactacggctccctgaacttccggagccgcatctccctcacccgggaccgcgacctgttcaccgcccacatggacatccgggggctgacgcagggcgacaccgccacctacttctgcgcccgccagaagttcgagagccggtacaccgggggccaggggtggtacttcgacctctggggccgcggcacgcacatcgtcgtgtccagc

SEQ ID NO: 11571 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagagccggtacaccgggggccaggggtggtacttcgacctgtggggccgcggcacccacatcgtggtgtccagc

SEQ ID NO: 11572 - RNA, 384 nt, synthetic construct
  misc_feature 1..384: note = derived and/or modified sequence opt1 from anti-HIV-1_HeavyChain
  source 1..384: mol_type = other RNA
caggtgcacctggagcagagcggctccggggtcaagaagcccggcgccagcgtgcgcgtgtcctgctggagctccgaggacatcttcgagcggaccgagctcatccactgggtccgccaggccccggggcagggcctggagtggatcgggtgggtgaagaccgtgacgggcgcggtcaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtggtgtccagc

SEQ ID NO: 11573 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctcggccgcgaccgggacctgtccaccgcctacatggacatccgcggcctgacccaggacgacacggccacctacttctgcgcccggcagaagttcgcgagccgctactccggggaccagggcagctacttcgacctctgggggcggggcaccctgatcgtggtctccagc

SEQ ID NO: 11574 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccagggcgacaccgccacctacttctgcgcccgccagaagttcgagtcccggtacaccgggggccaggggtggtacttcgacctctggggccgcggcacgcacatcgtggtgagctcc

SEQ ID NO: 11575 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgagggcatcttcgacaccacggagctcatctactgggtgcggcaggcgccggggcagggcctggagtggatcgggtgggtgaagatcgtcagcggcaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggggaccagggctcctacttcgacctctgggggcggggcaccctgatcgtggtcagctcc

SEQ ID NO: 11576 - RNA, 384 nt, synthetic construct
  misc_feature 1..384: note = derived and/or modified sequence opt1 from anti-HIV-1_HeavyChain
  source 1..384: mol_type = other RNA
cagagccgcctggagcagtccggcagcgccatgaagaagcccggggcctccgtgcgggtcagctgctggacctccgaggacatcttcgacaccacggagctcatctactgggtgcgccaggcgccgggccaggggctggagtggatcggctgggtgaagatcgtcagcgggaccgtgaacttcgcctccctggacttccggaaccgcatcagcctctcccgggaccgcgacctgagcaccgcccacatggacatccggggcctgacccaggacgacacggccacctacttctgcgcccgccagaagttcgcgtcccggtacagcggcgaccaggggtcctacttcgacctctggggccgcgggaccctgatcatcgtgagctcc

SEQ ID NO: 11577 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtcccgctacaccgggggccaggggtggtacttcgacctgtggggccggggcacccacatcgtggtgagctcc

SEQ ID NO: 11578 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcctacatggacatccgcggcctgacccaggacgacacggccacctacttctgcgcccggcagaagttcgcgagccgctactccggcgaccaggggagctacttcgacctgtggggccgggggaccctcatcatcgtgtccagc

SEQ ID NO: 11579 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcacggtgaacttcgccagcctggacttccggaaccgcatctccctcagccgggaccgcgacctgtccaccgcctacatggacatccggggcctgacccaggacgacaccgccacgtacttctgcgcccgccagaagttcgcgagccggtactccggggaccagggcagctacttcgacctctgggggcgcggcaccctgatcgtcgtgtccagc

SEQ ID NO: 11580 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggagctccgaggacatcttcgagcgcaccgagctgatccactgggtgcggcaggccccggggcagggcctcgagtggatcgggtgggtcaagacggtgaccggcgcggtgaacttcggcagcctggacttccgccaccggatctccctgacccgcgaccgggacctcttcaccgcccacatggacatccgcgggctgacgcagggcgacaccgccacctacttctgcgcccggcagaagttcgagagccgctacaccgggggccaggggtggtacttcgacctgtggggccggggcacgcacatcgtcgtgtccagc

SEQ ID NO: 11581 - RNA, 384 nt, synthetic construct
  misc_feature 1..384: note = derived and/or modified sequence opt1 from anti-HIV-1_HeavyChain
  source 1..384: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaacttcggctccctggacttccgccaccggatcagcctgacccgcgaccgggacctcttcacggcccacatggacatccgcgggctgacccagggcgacaccgccacctacttctgcgcccggcagaagttcgagtcccgctacaccgggggccaggggtggtacttcgacctgtggggccggggcacgcacatcgtcgtgagctcc

SEQ ID NO: 11582 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatcgtggtgagctccgcgagcaccaaggggccctccgtcttccacgacctgcgc

SEQ ID NO: 11583 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctccgccagcaccaaggggccctccgtgttccccaccatctgcgtc

SEQ ID NO: 11584 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaaggccgtgagcggcgccgtgaactacggctccctggacttccgccaccgggtcagcctcacccgcgaccgggacctgttcacggcccacatggacatccgcgggctgacccaggacgacaccgccatctacttctgcgcgcggcagaagttcgcccgcggcgaccaggggtggttcttcgacctctggggccgggggaccctgatcgtggtgtccagcgcctccacgaagggccccagcgtcttcccccacgacctgcgc

SEQ ID NO: 11585 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaaggccgtgtccggcgccgtcaactacggcagcctggacttccggcaccgcgtgtccctcacgcgggaccgcgacctgttcaccgcccacatggacatccgggggctgacccaggacgacaccgccatctacttctgcgcgcgccagaagttcgcccggggcgaccaggggtggttcttcgacctctggggccgcgggacgctgatcgtggtcagctccgccagcaccaagggcccgtccgtgttcccccacgacctgcgg

SEQ ID NO: 11586 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttctacgccgggggccaggggtggtacttcgacctgtggggccggggcaccctgatcgtggtgagctccgccagcaccaaggggccgtccgtcttcccccacgacctccgc

SEQ ID NO: 11587 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcccgggtcatcgtgagctccgccagcaccaagggcccctccgtgttcccccacgacctgcgc

SEQ ID NO: 11588 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgtcccgctacagcggcgaccaggggtcctacttcgacctctggggccgggggaccctgatcgtggtcagctccgccagcaccaagggcccctccgtgttccccacgatctacgtg

SEQ ID NO: 11589 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgaaggtcagctgcaaggcgtccggcgggaccctcagctcctacgccatcagctgggtgcgccaggccccgggccaggggctggagtggatcggctgggtgaagaccgtcacgggcgccgtgaacttcgggtccgcctgcttccggcaccgcgtgagcctgacccgggaccgcgacctcttcaccgcgcacatggacatccggggcctgacccagggggacacggccacctacttctgcgcccgccagaagttctacaagggcgggcagggctggtacttcgacctgtggggccgggggaccctcatcgtcgtgtccagc

SEQ ID NO: 11590 - RNA, 372 nt, synthetic construct
  misc_feature 1..372: note = derived and/or modified sequence opt1 from anti-HIV-1_HeavyChain
  source 1..372: mol_type = other RNA
cacgtgcgcctggtccagagcggcgccgaggtggagaagcccggggcctccgtgaaggtcagctgcgagacctccaactacccgttcaacatgtacggcatgacctgggtgcggcaggcgcccgggcagggcctcgagtggatcgggtgggtgaagatcgtcagcggcgccgtgaacttcggctcccccaacttccgccagcgggtgagcctgacgcgcgaccgggacctgttcaccgcccacatggacatccgcgggctcacccagggcgacaccgccacgtacttctgcgcccggcagaagttcgagcgcgggggccaggggtggatcttcgacctgtggggccggggcaccctgatcgcggtctccagc

SEQ ID NO: 11591 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacgtgttcgagcggaccgagctgatccactgggtccgccaggcgcccgggcagggcctggagtggatcgggtgggtgaaggccgtgtccggcgccgtcaactacggcagcctcgacttccggcaccgcgtgtccctgacgcgggaccgcgacctgttcaccgcccacatggacatccgggggctcacccaggacgacaccgccacgtacttctgcgcgcgccagaagttctacgccggcgggcagggctggtacttcgacctgtgggggcggggcaccctgatcgtggtcagctcc

SEQ ID NO: 11592 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggagctccgaggacatcttcgagcgcaccgagctgatccactgggtgcggcaggccccggggcagggcctcgagtggatcgggtgggtcaagacggtgaccggcgcggtgaacttcggcagcctggacttccgccaccggatctccctgacccgcgaccgggacctcttcaccgcccacatggacatccgcgggctgacgcagggcgacaccgccacctacttctgcgcccggcagaagttcgagcgcgggggccaggggtggtacttcgacctgtggggccggggcaccctcatcgtcgtgagctcc

SEQ ID NO: 11593 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagcggcccggcgccagcgtccgcgtgtcctgctggaccagcgaggacatcttcgagacgaccgagctgatccactgggtgcggcaggccccggggcagggcctcgagtggatcgggtgggtcaagaccgtgtccggcgcggtgaacttcggcagcctgaacttccgccaccgggtctccctgacccgcgaccgggacctcagcacggcccacatggacatccgcgggctgacccaggacgacaccgccacctacttctgcgcccggcagaagttcgcccgcggcgaccaggggtggttcttcgacctgtggggccgggggacgctcatcgtggtgtccagc

SEQ ID NO: 11594 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcgccgggatgaagaagcccggcgcgagcatgaccgtctcctgcaagaccgccgacgaggacgtgttcgacgccgcctacatgcactgggtgcgccaggccccggggcagacgttcgagtggctgggctggatgaagcccgtcaccggggcggtgaactacgcccggcagttccagggccgcgtgagcttctaccggacccgcgagctcggcatcgcctacatggacctgcgggacctgaagttcgacgacaccgccgtctacttctgcgcgcgcaagacgaagggggacgtgtccggcgacgaccgggggttcttcttcgacctctggggccgcgggacccgggtgatcgtcagctcc

SEQ ID NO: 11595 - RNA, 384 nt, synthetic construct
  misc_feature 1..384: note = derived and/or modified sequence opt1 from anti-HIV-1_HeavyChain
  source 1..384: mol_type = other RNA
caggtgcacctggagcagagcggctccggggtcaagaagcccggcgccagcgtgcgcgtgtcctgctggaccagcgaggacatcttcgagcggaccgagctcatccactgggtccgccaggccccggggcagggcctggagtggatcgggtgggtgaagacggtgaccggcgcggtcaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtggtgagctcc

SEQ ID NO: 11596 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggcccgagcgtcttccccaccatctgcgtg

SEQ ID NO: 11597 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttccccacgatctgcgtg

SEQ ID NO: 11598 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagctcggcgccagcgtccgcgtgtcctgctggaccagcgaggacgtgttcgagcggaccgagctgatccactgggtccgccaggcgcccgggcagggcctggagtggatcgggtgggtgaaggccgtgtccggcgccgtcaactacggcagcctcgacttccggcaccgcgtgtccctgacgcgggaccgcgacctgttcaccgcccacatggacatccgggggctcacccaggacgacaccgccacgtacttctgcgcgcgccagaagttctacgccggcgggcagggctggtacttcgacctgtgggggcggggcaccctgatcgtggtcagctccgccagcaccaagggcccgtccgtgttcccccacgacctccgc

SEQ ID NO: 11599 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggtacttcgacctgtggggccggggcaccctcatcgtggtgagctcc

SEQ ID NO: 11600 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgaccggcgccgtgaacttcggctccctcgacttccggcaccgcatcagcctgacccgggaccgcgacctgttcaccgcccacatggacatccgggggctcacgcagggcgacaccgccacctacttctgcgcccgccagaagttcgagtcccggtacaccgggggccaggggtggtacttcgacctgtggggccgcggcacgcacatcgtcgtgagctcc

SEQ ID NO: 11601 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaaggggcccagcgtgttccccaccatctgcgtc

SEQ ID NO: 11602 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgagcgcgggggccaggggtggtacttcgacctgtggggccggggcacgctcatcgtggtgtccagc

SEQ ID NO: 11603 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggggccgaggtgaagaagcccggggcctccgtgaaggtcagctgcaaggcgtccggctacacctacaccacgtacggggtgagctggctccgccaggtgccgggccagcggcccgagtggatggggtggatccgccccaagaccggcgcccggaaccaggcccgccagttccagccccggatctccctgacccgcgaccgggccctgagcaccgcctacctcgacctgaactccctgacgagcgcggactccggcacctacttctgcgcccgccagaccttcaagccggacttctacttcgccgaccaggggtggagcttcaacctctggggccggggcgcccacttcatcgtctccagc

SEQ ID NO: 11604 - RNA, 384 nt, synthetic construct
  misc_feature 1..384: note = derived and/or modified sequence opt1 from anti-HIV-1_HeavyChain
  source 1..384: mol_type = other RNA
cgcgcccacctggagcagagcggctccggggtgaagaagctcggcgccagcgtccgggtgtcctgctggaccagcgaggacatcttcgagcgcaccgagctgatccactgggtgcggcaggcgcccgggcagggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccaggacgacaccgccacgtacttctgcgcgcggcagaagttcgagagccgctacaccggcgggcagggctggtacttcgacctgtgggggcggggcacccacatcaccgtgtccagc

SEQ ID NO: 11605 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtactactgcgcccgccagaagttcgagcgcgggggccaggggtggatcttcgacctgtggggccggggcaccctcatcgcggtgagctcc

SEQ ID NO: 11606 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccacgggaccctgatcgtggtgagctcc

SEQ ID NO: 11607 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgggtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccacggcaccctcatcgtggtgtccagc

SEQ ID NO: 11608 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgacggggacctcttcaccgcccacatggacatccggggcctgacccagggggacacggccacctacttctgcgcccgccagaagttctacgcgggcgggcagggctggtacttcgacctgtggggccgggggaccctcatcatcgtgtccagc

SEQ ID NO: 11609 - RNA, 372 nt, synthetic construct
  misc_feature 1..372: note = derived and/or modified sequence opt1 from anti-HIV-1_HeavyChain
  source 1..372: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggccaccagatcagcgaccgcgtctccctgacccgggaccgcgacctcttcaccgcccacatggacatccgggggctgacccagggcgacacggccacctacttctgcgcccgccagaagttctacgccgggggccaggggtggtacttcgacctgtggggccacggcaccctcatcgtggtgagctcc

SEQ ID NO: 11610 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgggtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccacggcaccctcatcgtggtgagctcc

SEQ ID NO: 11611 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgagcggcgccgtgaacttcggctcccccaacttccggcaccgcgtcagcctgacccgggaccgcgacctcttcaccgcccacatggacatccgggggctgacccagggcgacacggccacctactactgcgcgcgccagaagttcgagcgcgggggccaggggtggtacttcgacctgtggggccggggcaccctcatcgtggtgtccagc

SEQ ID NO: 11612 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccaggacgacaccgccacgtactactgcgcgcggcagaagttcgagcgcggcgggcagggctggatcttcgacctgtgggggcggggcaccctgatcgccgtgagctcc

SEQ ID NO: 11613 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctactactgcgcccggcagaagttctacgccgggggccaggggtggtacttcgacctgtggggccgcggcaccctcatcgtggtgtccagc

SEQ ID NO: 11614 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttctacaagggcgggcaggggtggtacttcgacctgtggggccggggcaccctcatcgtggtgtccagc

SEQ ID NO: 11615 - RNA, 372 nt, synthetic construct
  misc_feature 1..372: note = derived and/or modified sequence opt1 from anti-HIV-1_HeavyChain
  source 1..372: mol_type = other RNA
tacgtggagctgggcaccaacaccgggcccgaggtccgcaagccgggcgccagcgtgaagatctcctgcaagacgagcgggtacatcttcaccgacaactacttccactggctccggcaggcccccgcggtgggcctggagtggatggggtggatcaactcccacaacggctacaccaagagcgccaagaagttccagggccgcatcaccatgacgcgggacaccgccgtcgacaccgcctacatggagctgatcgacctcacctccgacgacacggccacctactactgcgcgcgccagaagttctacgccgggggccaggggtggtacttcgacctgtggggctgcgggaccctgatcgtggtgagctcc

SEQ ID NO: 11616 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatctgcgtgtccagc

SEQ ID NO: 11617 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccagcgacttccggcagcgcgtctccctgacccgggaccgcgacctcttcaccgcccacatggacatccgggggctgacgcagggcgacaccgccacctactactgcgcccgccagaagttctacgccgggggccaggggtggtacttcgacctgtggggccggggcaccctcatcgtggtgagctcc

SEQ ID NO: 11618 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagcccgtgacgggcgccgtgaacttcggctcccccaacttccggcaccgcgtcagcctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgtccagc

SEQ ID NO: 11619 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgcgcgtcagctgctggacctccgaggacatcttcgagaagtccgagctcatccactgggtgcggcaggcgccgggccaggggctggagtggatcggctgggtgaagaccgtcacgggggccgtgaacttcggcagcagcgacttccgccagcgggtgtccctgacccgcgaccgggacctcttcaccgcccacatggacatccgcggcctgacccagggggacacggccacctactactgcgcccggcagaagttcgagcgcggcgggcagggctggtacttcgacctgtgggggcggggcaccctcatcgtcgtgagctcc

SEQ ID NO: 11620 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtactcctgcgcgcgccagaagttcgcccggggcgaccaggggtggttcttcgacctgtggggccgcgggaccctgatcgtggtgagctcc

SEQ ID NO: 11621 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctactactgcgcccgccagaagttcgagcgcgggggccaggggtggtacttcgacctgtggggccggggcacgctcatcgtggtgtccagc

SEQ ID NO: 11622 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgggtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccagggcgacaccgccacctacttctgcgcccgccagaagttcgcccgcggggaccagggctggttcttcgacctctgggggcacggcacgctgatcgtggtgtccagc

SEQ ID NO: 11623 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgggtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgaccccttcaccgcccacatggacatccgggggctcacgcagggcgacaccgccacctacttctgcgcccgccagaagttcgagcgcgggggccaggggtggtacttcgacctgtggggccacggcaccctgatcgtggtgtccagc

SEQ ID NO: 11624 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatctgcgggctgacgcagggcgacaccgccacctacttctgcgcccggcagaagttcgagcgcgggggccaggggtggtacttcgacctgtggggccacggcaccctcatcgtggtgtccagc

SEQ ID NO: 11625 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcagcgcgtctccctgacgcgggaccgcgacctgttcaccgcccacatggacatccgggggctcacccagggcgacaccgccacgtactactgcgcgcgccagaagttctacgccgggggccaggggtggtacttcgacctgtggggccggggcaccctgatcgtggtgagctcc

SEQ ID NO: 11626 - RNA, 372 nt, synthetic construct
  misc_feature 1..372: note = derived and/or modified sequence opt1 from anti-HIV-1_HeavyChain
  source 1..372: mol_type = other RNA
caggcgcacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccacggcaccctcatcgtggtgtccagc

SEQ ID NO: 11627 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgggtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgcccgcggggaccagggctggttcttcgacctgtgggggcacggcacgctcatcgtggtgtccagc

SEQ ID NO: 11628 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtactactgcgcgcgccagaagttcgcccggggcgaccaggggtggttcttcgacctgtggggccgcgggaccctgatcgtggtgagctcc

SEQ ID NO: 11629 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaaggtcagctgcaaggcgtccggctacaccttcaccgactactacctccactgggtgcgccaggccccggggcagggcctggactgggtggggtggatcaaccccaacagcggcggcacgaactacgcccagaagttccaggggcgggtcgccatgacccgcgacacctccctgagctccgtgtacctcgacctgaacagcctgacctccgccgacagcggcacgtacttctgcgcgcggcagaccttcaagcccgacttctacttcgccgaccaggggtggtccttcaacctctggggccaggggagccacttcatcgtgtccagc

SEQ ID NO: 11630 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcgcgcgccggggcagggcctggagtggatcgggtgggtcaagaccgtgacgggcgccgtgaacttcggcagctccgacttccggcagcgcgtcagcctgacccgggaccgcgacctcttcaccgcccacatggacatccgggggctgacccagggcgacacggccacctactactgcgcccgccagaagttctacgccgggggccaggggtggtacttcgacctgtggggccggggcaccctcatcgtggtgtccagc

SEQ ID NO: 11631 - RNA, 372 nt, synthetic construct
  misc_feature 1..372: note = derived and/or modified sequence opt1 from anti-HIV-1_HeavyChain
  source 1..372: mol_type = other RNA
caggcgcacctggagcagagcggctccggggtgaagaagcccggcgccagcgtcaccgtgtcctgctggaccagcgaggacatcttcgagaagtccgagctcatccactgggtgcgccaggcgccggggcagggcctggagtggatcgggtgggtcaagacggtgaccggcgccgtgaacctggtctaccagatcagcgaccgggtgtccctcacccgcgaccggggcctgttcaccgcccacatggacatccgcgggctgacgcagggcgacaccgccacctactactgcgcccggcagaagttctacgccgggggccaggggtggtacttcgacctctggggccgcggcaccctgatcgtggtcagctcc

SEQ ID NO: 11632 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctacttctgcgcgcggcagaagttctacaagggcgggcagggctggtacttcgacctgtggggccacgggaccctcatcgtggtgagctcc

SEQ ID NO: 11633 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaactacggctccctgaacttccggagccgcatctccctcacccgggaccgcgacctgttcaccgcccacatggacatccgggggctgacggagggcgacaccgccacctacttctgcgcccgccagaagttctacgccgggggccaggggtggtacttcgacctctggggccacggcaccctgatcgtcgtgagctcc

SEQ ID NO: 11634 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgggtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacatggccacgtacttctgcgcccgccagaagttcgagcgcgggggccaggggtggtacttcgacctgtggggccacggcaccctcatcgtggtgagctcc

SEQ ID NO: 11635 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaaggagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgccgtgtccagc

SEQ ID NO: 11636 - RNA, 375 nt, synthetic construct
  misc_feature 1..375: note = derived and/or modified sequence opt1 from anti-HIV-1_HeavyChain
  source 1..375: mol_type = other RNA
caggtgcagctggagcagagcggctccggggtcaagaagctcggcgccagcgtgcgcgtgtcctgctggaccagcgaggacatcttcgggcggaccgagctgatccactgggtccgccaggcccccggccaggggctggagtggatcggctgggtgaaggcggtgtccggcgccgtcaactacgggagcctcgacttccggcaccgcgtgtccctgacgcgggaccgcgacctgttcaccgcccacatggacatccggggcctcacccaggacgacaccgccacgtactactgcgcccgccagaagttcgcgcgcggggaccagggctggttcttcgacctgtgggggcggggcaccctgatcgtggtcagctcc

SEQ ID NO: 11637 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgacgacatcttcaagaccgagctcatccactgggtgcggcaggcgccggggcagggcctggagtggatcgggtgggtcaagacggtgaccggcgccgtgaacttcggctcccccaacttccgccagcgggtcagcctgacccgcgaccgggacctcttcaccgcccacatggacatccgcgggctgacgcaggacgacaccgccacctacttctgcgcccggcagaagttcgcgcgcggcgaccaggggtggttcttcgacctgtggggccgggggaccctcatcgtggtgtccagc

SEQ ID NO: 11638 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctactactgcgtgcgccagaagttcgagcgcgggggccaggggtggtacttcgacctgtggggccggggcaccctcatcgtggtctccagc

SEQ ID NO: 11639 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgaaggtcagctgctggacctccgaggacatcttcgagaagtccgagctcatccactgggtgcgccaggcgccgggccaggggctggagtggatcggctgggtgaagaccgtcacgggggccgtgaacttcggcagcagcgacttccggcagcgcgtgtccctgacccgggaccgcgacctcttcaccgcccacatggacatccggggcctgacccagggggacacggccacctactactgcgcccgccagaagttctacgcgggcgggcagggctggtacttcgacctgtgggggcggggcaccctcatcgtcgtgagctcc

SEQ ID NO: 11640 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttctacaagggcgggcaggggtggtacttcgacctgtggggccggggcaccctgatcgtggtgagctcc

SEQ ID NO: 11641 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcgcccaccagatcagcgaccgcgtctccctgacccgggaccgcgacctcttcaccgcccacatggacatccggggcctgacccagggggacacggccacctactactgcgcgcgccagaagttctacgccggcgggcagggctggtacttcgacctgtgggggcggggcaccctcatcgtggtgagctcc

SEQ ID NO: 11642 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgggcggaccgagctcatccactgggtgcgccaggcgccgggccaggggctggagtggatcggctgggtcaagacggtgtccggcgccgtgaacttcgggagccccaacttccggcaccgcgtctccctgacccgggaccgcgacctcttcaccgcccacatggacatccggggcctgacccagggggacacggccacctacttctgcgcccgccagaagttcgagcggggcgggcagggctggtacttcgacctgtggggccgcgggaccctcatctgcgtgagctcc

SEQ ID NO: 11643 - RNA, 636 nt, synthetic construct
  misc_feature 1..636: note = derived and/or modified sequence opt1 from anti-HIV_5CIN_LightChain
  source 1..636: mol_type = other RNA
gagatcgtgctgacccagagccccggcacccagtccctcagcccgggggagcgcgccacgctgtcctgccgggccagccagtccgtcggcaacaacaagctggcgtggtaccagcagcgccccgggcaggcgccccggctcctgatctacggcgccagctcccgccccagcggggtggccgaccggttctccggcagcggctccgggaccgacttcaccctgaccatcagccgcctcgagccggaggacttcgccgtgtactactgccagcagtacggccagtccctgagcacgttcgggcagggcaccaaggtcgaggtgaagcggaccgtggccgccccctccgtcttcatcttcccgcccagcgacgagcagctgaagtccgggaccgccagcgtggtgtgcctcctgaacaacttctacccccgcgaggccaaggtccagtggaaggtggacaacgcgctgcagtccggcaacagccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgg

SEQ ID NO: 11644 - RNA, 672 nt, synthetic construct
  misc_feature 1..672: note = derived and/or modified sequence opt1 from anti-HIV_5CIN_HeavyChain
  source 1..672: mol_type = other RNA
gtgcagctggtccagagcggcgccgaggtgaagcgccccgggtccagcgtgaccgtctcctgcaaggccagcggcgggtccttcagcacctacgcgctctcctgggtgcggcaggccccgggccgcgggctggagtggatgggcggcgtgatccccctgctcacgatcaccaactacgcgccccggttccaggggcgcatcaccatcaccgccgaccggagcacgtccaccgcctacctggagctgaacagcctccgccccgaggacaccgccgtctactactgcgcccgggagggcaccacggggtccggcgggaagccgatcggcgccttcgcccactggggccaggggaccctggtgaccgtgagctccgcgagcaccaagggcccctccgtcttccccctggcccccagctccaagagcacgtccgggggcaccgccgccctcggctgcctggtgaaggactacttcccggagcccgtgaccgtcagctggaacagcggggccctgacctccggcgtgcacacgttccccgcggtgctccagagctccgggctgtacagcctgtccagcgtcgtgaccgtgccctccagctccctcggcacccagacctacatctgcaacgtcaaccacaagccgagcaacacgaaggtggacaagaaggtggagccc

SEQ ID NO: 11645 - RNA, 678 nt, synthetic construct
  misc_feature 1..678: note = derived and/or modified sequence opt1 from anti-HIV_5CIL_HeavyChain
  source 1..678: mol_type = other RNA
gtgcagctggtccagagcggcgccgaggtgaagcgccccgggtccagcgtgaccgtctcctgcaaggccagcggcgggtccttcagcacctacgcgctctcctgggtgcggcaggccccgggccgcgggctggagtggatgggcggcgtgatccccctgctcacgatcaccaactacgcgccccggttccaggggcgcatcaccatcaccgccgaccggagcacgtccaccgcctacctggagctgaacagcctccgccccgaggacaccgccgtctactactgcgcccgggagggcaccacgggggacggcgacctggggaagccgatcggcgccttcgcccactggggccaggggaccctggtgaccgtgtccagcgcgtccaccaagggccccagcgtcttccccctcgccccctccagcaagtccacgagcgggggcaccgccgccctgggctgcctggtgaaggactacttcccggagcccgtgaccgtctcctggaacagcggggccctcaccagcggcgtgcacacgttccccgcggtgctgcagtccagcgggctgtactccctcagctccgtcgtgaccgtgcccagctccagcctgggcacccagacctacatctgcaacgtcaaccacaagccgtccaacacgaaggtggacaagaaggtggagccc

SEQ ID NO: 11646 - RNA, 678 nt, synthetic construct
  misc_feature 1..678: note = derived and/or modified sequence opt1 from anti-HIV_5CIP_A-Chain
  source 1..678: mol_type = other RNA
gtgcagctggtccagagcggcgccgaggtgaagcgccccgggtccagcgtgaccgtctcctgcaaggccagcggcgggtccttcagcacctacgcgctctcctgggtgcggcaggccccgggccgcgggctggagtggatgggcggcgtgatccccctgctcacgatcaccaactacgcgccccggttccaggggcgcatcaccatcaccgccgaccggagcacgtccaccgcctacctggagctgaacagcctccgccccgaggacaccgccgtctactactgcgcccgggagggcaccacggggtggggctggctggggaagccgatcggcgccttcgcccactggggccaggggaccctggtgaccgtgtccagcgcgtccaccaagggccccagcgtcttccccctcgccccctccagcaagtccacgagcgggggcaccgccgccctgggctgcctggtgaaggactacttcccggagcccgtgaccgtctcctggaacagcggggccctcaccagcggcgtgcacacgttccccgcggtgctgcagtccagcgggctgtactccctcagctccgtcgtgaccgtgcccagctccagcctgggcacccagacctacatctgcaacgtcaaccacaagccgtccaacacgaaggtggacaagaaggtggagccc

SEQ ID NO: 11647 - RNA, 681 nt, synthetic construct
  misc_feature 1..681: note = derived and/or modified sequence opt1 from anti-HIV_5CIP_HeavyChain
  source 1..681: mol_type = other RNA
gtgcagctggtccagagcggcgccgaggtgaagcgccccgggtccagcgtgaccgtctcctgcaaggccagcggcgggtccttcagcacctacgcgctctcctgggtgcggcaggccccgggccgcgggctggagtggatgggcggcgtgatccccctgctcacgatcaccaactacgcgccccggttccaggggcgcatcaccatcaccgccgaccggagcacgtccaccgcctacctggagctgaacagcctccgccccgaggacaccgccgtctactactgcgcccgggagggcaccacggggtggggctggctggggaagccgatcggcgccttcgcccactggggccaggggaccctggtgaccgtgtccagcgcgtccaccaagggccccagcgtcttccccctcgccccctccagcaagtccacgagcgggggcaccgccgccctgggctgcctggtgaaggactacttcccggagcccgtgaccgtctcctggaacagcggggccctcaccagcggcgtgcacacgttccccgcggtgctgcagtccagcgggctgtactccctcagctccgtcgtgaccgtgcccagctccagcctgggcacccagacctacatctgcaacgtcaaccacaagccgtccaacacgaaggtggacaagaaggtggagcccaag

SEQ ID NO: 11648 - RNA, 630 nt, synthetic construct
  misc_feature 1..630: note = derived and/or modified sequence opt1 from anti-HIV_4JKP_LightChain
  source 1..630: mol_type = other RNA
gagatcgtgctgacccagagccccgccaccctctccctgagcccgggcgagacggccatcatctcctgccgcaccagccagtacgggtccctggcgtggtaccagcagcggcccggccaggcgccccgcctcgtcatctacagcgggtccacccgggccgccggcatccccgaccgcttcagcgggtcccggtggggcgccgactacaacctgagcatctccaacctggagagcggcgacttcggggtgtactactgccagcagtacgagttcttcggccaggggaccaaggtgcaggtcgacatcaagcgcacggtggccgccccgtccgtgttcatcttcccgcccagcgacgagcagctcaagtccggcaccgccagcgtcgtgtgcctgctgaacaacttctacccccgggaggccaaggtgcagtggaaggtcgacaacgcgctccagtccgggaacagccaggagtccgtgaccgagcaggacagcaaggacagcacctactccctgagctccacgctgaccctcagcaaggccgactacgagaagcacaaggtgtacgcctgcgaggtcacccaccagggcctgtccagccccgtgaccaagtccttcaaccgcggcgagtgc

SEQ ID NO: 11649 - RNA, 678 nt, synthetic construct
  misc_feature 1..678: note = derived and/or modified sequence opt1 from anti-HIV_3TNN_E-Chain
  source 1..678: mol_type = other RNA
gaggtgcagctggtcgagagcggcgggggcctcgtgcagcccgggggctccctgcgcctgagctgcgccgcctccgggttcaccttcagcacctacgcgatgtcctgggtgcggcaggccccgggcaagggcctcgagtgggtcagctccatcaacaacagcgggcgcaacacgttctccgccgacagcgtgaagggccggttcaccatctcccgcgacaacagcaagaacaccctgttcctggtgatgaactccctccgggccgaggacaccgccgtctactactgcgcgaaggacctgcgcctcgggggcgggagcgactactggggccagggcacgctggtgaccgtgtccagcgcctccaccaaggggcccagcgtcttccccctggccccctccagcaagagcacctccggcgggacggccgcgctgggctgcctcgtgaaggactacttcccggagcccgtgaccgtcagctggaactccggcgccctgaccagcggggtgcacaccttccccgccgtgctgcagtccagcggcctctactccctgagctccgtcgtgacggtgcccagctccagcctggggacccagacctacatctgcaacgtcaaccacaagccgtccaacaccaaggtggacaagcgggtggagcccaagagctgcgacaagacgcac

SEQ ID NO: 11650 - RNA, 705 nt, synthetic construct
  misc_feature 1..705: note = derived and/or modified sequence opt1 from anti-HIV_3BQU_B-Chain
  source 1..705: mol_type = other RNA
cgcatcaccctgaaggagagcgggcccccgctcgtgaagcccacccagacgctgaccctgacctgctccttcagcgggttctccctcagcgacttcggcgtcggggtgggctggatccggcagccgcccgggaaggccctggagtggctggccatcatctactccgacgacgacaagcgctacagcccctccctcaacacccggctgacgatcaccaaggacaccagcaagaaccaggtggtcctggtgatgacccgcgtgtcccccgtcgacacggcgacctacttctgcgcccaccggcgcggccccaccaccctcttcggcgtgcccatcgcccgggggccggtgaacgccatggacgtctggggccaggggatcacggtgaccatcagctccaccagcaccaagggcccctccgtgttccccctggcccccagctccaagagcacggcgggcggcgccgccgccctgggctgcctcgtcaaggactacttcccggagcccgtgaccgtgtcctggaacagcggggcgctgacctccggcgtccacaccttccccgccgtgctgcagagcagcgggctctactccctgagctccgtggtcacggtgcccagctccagcctgggcacccagacctacacgtgcaacgtgaaccacaagccgtccaacaccaaggtcgacaagcgcgtggagcccaagagctgc

SEQ ID NO: 11651 - RNA, 642 nt, synthetic construct
  misc_feature 1..642: note = derived and/or modified sequence opt1 from anti-HIV_3BQU_A-Chain
  source 1..642: mol_type = other RNA
gccctgcagctcacgcagagcccctccagcctgtccgccagcgtgggcgaccgcatcaccatcacgtgccgggcgtcccagggggtcaccagcgccctggcctggtaccgccagaagccgggctccccgccccagctcctgatctacgacgccagctccctggagagcggggtgccctcccggttcagcggctccgggagcggcaccgagttcaccctcacgatctccaccctgcgccccgaggacttcgccacctactactgccagcagctgcacttctacccccacaccttcggcgggggcacgcgggtggacgtccgccggaccgtggcggcccccagcgtgttcatcttcccgccctccgacgagcagctcaagagcgggaccgcctccgtcgtgtgcctgctgaacaacttctacccccgcgaggccaaggtgcagtggaaggtcgacaacgcgctccagagcggcaacagccaggagtccgtgaccgagcaggacagcaaggactccacgtacagcctgtccagcaccctgaccctctccaaggccgactacgagaagcacaaggtgtacgagtgcgaggtcacccaccaggggctgagctcccccgtgaccaagagcttcaaccggggcgagtgc

SEQ ID NO: 11652 - RNA, 387 nt, synthetic construct
  misc_feature 1..387: note = derived and/or modified sequence opt1 from anti-HIV_IgG_VR-Chain
  source 1..387: mol_type = other RNA
atggagacccccgcccagctcctgttcctgctgctcctgtggctgccggacaccacgggcgagatcgtgctcacccagagccccgggaccctgtccctgagcgccggcgagcgcgcgaccctctcctgccgggccagccagtccgtcagctcccgctacctggcctggtaccagcagaagcccgggcaggcgccccggctgctcatctacggcgccagctcccgcgccacggggatcccggaccggttcagcggctccggcagcgggaccgacttcaccctgaccatctcccgcgtggagcccgaggacttcgccggctactactgccagcagtacgacaacagcgtgtgcacgttcgggcagggcaccaagctggagatcaagcgg

SEQ ID NO: 11653 - RNA, 348 nt, synthetic construct
  misc_feature 1..348: note = derived and/or modified sequence opt1 from anti-HIV_IgG_HeavyChain
  source 1..348: mol_type = other RNA
atgaagcacctgtggttcttcctcctgctggtggccgcgccccgctgggtcctcagccaggtgcagctgcaggagtccggcccggggctggtgaagcccagcgagaccctctccctgacctgcacggtcagcggcgggtccatcagctcccactactggagctggatccggcagtcccccggcaaggggctgcagtggatcggctacatctactacagcggctccaccaactacagcccctccctcaagagccgcgtgaccatctccgtggagaccagcaagaaccagttctccctgaagctgacgagcatgaccgccgccgacaccgccgtctactactgcgcccgg

SEQ ID NO: 11654 - RNA, 714 nt, synthetic construct
  misc_feature 1..714: note = derived and/or modified sequence opt1 from anti-HIV_4P9M_HeavyChain
  source 1..714: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgccgggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgacaagtggtccgggctccaccacgacggcgtcatggccttcagctcctgggggcagggcacgctgatcagcgtgtccgcggccagcaccaaggggcccagcgtgttccccctggccccctccagcaagtccaccagcggcggcaccgccgcgctcgggtgcctggtcaaggactacttccccgagcccgtgacggtgtcctggaacagcggcgccctgacctccggggtccacaccttcccggccgtgctccagagctccggcctgtacagcctgtccagcgtggtcaccgtgccctccagctccctcggcacgcagacctacatctgcaacgtgaaccacaagcccagcaacaccaaggtcgacaagcgcgtggagcccaagtcctgcgacaagacc

SEQ ID NO: 11655 - RNA, 645 nt, synthetic construct
  misc_feature 1..645: note = derived and/or modified sequence opt1 from anti-HIV_4P9M_LightChain
  source 1..645: mol_type = other RNA
gacatccagatgacgcagagcccctccaccctgagcgcctccatcggcgacacggtgcgcatcagctgccgggcctcccagagcatcaccgggaactgggtcgcgtggtaccagcagcgcccgggcaaggcgccccggctcctgatctaccgcggggccgccctgctcggcggggtgccctcccggttcagcggctccgccgccggcaccgacttcaccctgacgatcgggaacctgcaggccgaggacttcggcaccttctactgccagcagtacgacacctaccccgggaccttcggccaggggacgaaggtggaggtcaagcgcaccgtggccgccccgagcgtgttcatcttcccgccctccgacgagcagctcaagagcggcaccgcgtccgtcgtgtgcctgctgaacaacttctacccccgggaggccaaggtgcagtggaaggtcgacaacgccctccagagcggcaactcccaggagagcgtgaccgagcaggactccaaggacagcacgtactccctgagcagcaccctgaccctctccaaggccgactacgagaagcacaaggtgtacgcctgcgaggtcacccaccaggggctgagctcccccgtgaccaagagcttcaaccgcggcgagtgc

SEQ ID NO: 11656 - RNA, 558 nt, synthetic construct
  misc_feature 1..558: note = derived and/or modified sequence opt1 from anti-HIV_4P9H_C-Chain
  source 1..558: mol_type = other RNA
aagaaggtggtcctgggcaagaagggggacaccgtggagctgacctgcacggccagccagaagaagtccatccagttccactggaagaacagcaaccagatcaagatcctgggcaaccaggggtccttcctgaccaagggccccagcaagctcaacgaccgcgccgactcccggcgcagcctgtgggaccaggggaacttcccgctgatcatcaagaacctcaccatcgaggactccgacacctacatctgcgaggtggaggaccagaaggaggaggtccagctgctggtgttcggcctcacggcgaacagcgacacccacctcctgcagggccagtccctcaccctgaccctggagagcccgcccgggtccagcccctccgtgcagtgccggagcccccgcggcaagaacatccagggcgggaagacgctctccgtcagccagctggagctgcaggactccgggacctggacctgcaccgtgctccagaaccagaagaaggtggagttcaagatcgacatcgtcgtgctggccttccagaaggccatcgacggccgg

SEQ ID NO: 11657 - RNA, 462 nt, synthetic construct
  misc_feature 1..462: note = derived and/or modified sequence opt1 from anti-HIV_4YBL_A-Chain
  source 1..462: mol_type = other RNA
gtgcccgtctggaaggacgccgacaccaccctgttctgcgccagcgacgcgaaggcccacgagacggagtgccacaacgtgtgggccacccacgcctgcgtgccgaccgaccccaacccccaggagatccacctcgagaacgtcaccgagaacttcaacatgtggaagaacaacatggtggagcagatgcaggaggacgtgatctccctgtgggaccagtgcctgcagcccggcggggccccgaagatcagcttcgaccccatccccatccactactgcacgcccgcgggctacgtcatcctcaagtgcaacgacaagaacttcaacgggaccggcccgtgcaagaacgtgtccagcgtgcagtgcacccacgggatcaagcccgtcgtgtccagcggcggcgggaacatcaaggacaactggcgctccgagctgtacaagtacaaggtggtccagatcgag

SEQ ID NO: 11658 - RNA, 1056 nt, synthetic construct
  misc_feature 1..1056: note = derived and/or modified sequence opt1 from anti-HIV_4R4N_V-Chain
  source 1..1056: mol_type = other RNA
atctggaaggacgccaacaccaccctgttctgcgccagcgacgcgaaggcctacgacacggaggtgcacaacgtctgggccacccacgcctgcgtgcccaccgacccgagcccccaggagctcaagatggagaacgtgaccgaggagttcaacatgtggaagaacaacatggtcgagcagatgcacacggacatcatctccctgtgggaccagtccctgaagccctgcgtgcagctcaccggcgggagcgccctgacccaggcgtgccccaaggtgaccttcgagccgatccccatccactactgcgcccccgccggctacgccatcctgaagtgcaacgacaaggagttcaacgggacgggcctctgcaagaacgtctccaccgtgcagtgcacccacgggatccgccccgtggtcagcacccagctgctgctcaacggctccctggcggagggcaaggtgatgatccggagcgagaacatcacgaacaacgtgaagaacatcatcgtccagctgaacgagtccgtgaccatcaactgcacccgcccgaacaacgggggcagcgggtccggcggggacatccggcaggcccactgcaacgtgagcggctcccagtggaacaagaccctccaccaggtcgtggagcagctgcgcaagtactggaacaacaacacgatcatcttcaacagctccagcggcggggacctggagatcaccacccactccttcaactgcggcggggagttcttctactgcaacaccagcggcctcttcaactccacgtgggtgaacggcaccgccagcatcgagaacgggaccatcaccctgccctgccggatcaagcagatcatcaacatgtggcagcgcgtcggccaggccatctacgccccgcccatccagggggtgatccggtgcgtgagcaacatcacgggcctgatcctcacccgcgacgggggcggcaactccaacgagaacgagaccttccggcccgggggcggggacatgcgcgacaactggcggagcgagctgtacaagtacaaggtcgtgaagatcgag

SEQ ID NO: 11659 - RNA, 1065 nt, synthetic construct
  misc_feature 1..1065: note = derived and/or modified sequence opt1 from anti-HIV_4JKP_G-Chain
  source 1..1065: mol_type = other RNA
gtgtggaaggacgccgacaccaccctgttctgcgccagcgacgcgaaggcccacgagacggagtgccacaacgtctgggccacccacgcctgcgtgcccaccgaccccaacccccaggagatccacctcgagaacgtgaccgagaacttcaacatgtggaagaacaacatggtcgagcagatgcaggaggacgtgatctccctgtgggaccagtgcctgcagccctgcgtgaagctcacgggcgggagcgtcatcaagcaggcctgccccaagatctccttcgacccgatccccatccactactgcacccccgcgggctacgtgatcctgaagtgcaacgacaagaacttcaacgggaccggcccctgcaagaacgtgagctccgtccagtgcacccacgggatcaagccggtggtgagcacgcagctgctcctgaacggctccctggccgaggaggagatcatcatccgcagcgagaacctcaccaacaacgccaagaccatcatcgtccacctgaacaagtccgtggagatcaactgcacccggcccagcaacggcgggtccggcagcgggggcgacatccgcaaggcctactgcgagatcaacgggacgaagtggaacaaggtgctgaagcaggtcaccgagaagctcaaggagcacttcaacaacaagaccatcatcttccagccgccctccggcggcgacctggagatcaccatgcaccacttcaactgccgcggggagttcttctactgcaacacgacccagctgttcaacaacacgtgcatcggcaacgagaccatgaaggggtgcaacggcaccatcaccctcccctgcaagatcaagcagatcatcaacatgtggcagggcaccgggcaggcgatgtacgccccgcccatcgacggcaagatcaactgcgtgagcaacatcaccgggatcctgctgacgcgggacggcggggccaacaacacctccaacgagaccttccggcccggcggcgggaacatcaaggacaactggcgcagcgagctctacaagtacaaggtggtccagatcgagggctcc

SEQ ID NO: 11660 - RNA, 723 nt, synthetic construct
  misc_feature 1..723: note = derived and/or modified sequence opt1 from anti-HIV_3BQU_D-Chain
  source 1..723: mol_type = other RNA
atgggctggagctggatcttcctgttcctcctgtccgggaccgccggcgtgcacagcggggtccagctgcagcagtccggccccgagctcgtgaagccgggggccagcgtgaagatgtcctgcaaggcgagcggctactccttcaccgactacttcatgcactgggtcaagcagagccacggcaagtccctggactggatcgggtacatcaactgctacacgggcgccaccaactacagccagaagttcaaggggaaggccaccttcaccgtggacacgtccagcaacaccgcctacatgcagttcaactccctgaccagcgaggactccgccgtgtactactgcgcgcgcaccagcatcggctacgggtccagcccgcccttcccctactggggccagggcacgctcgtcaccgtgtccgccgccaagaccaccccgcccagcgtgtaccccctggcccccgggagcgcggcccagacgaactccatggtcaccctgggctgcctcgtgaaggggtacttccccgagcccgtgaccgtcacctggaacagcggctccctgagctccggcgtgcacacgttccccgccgtgctgcagagcgacctctacaccctgtccagctccgtcaccgtgcccagctccccgcggcccagcgagaccgtgacgtgcaacgtcgcccaccccgcctccagcaccaaggtggacaagaagatcgtgccccgc

SEQ ID NO: 11661 - RNA, 699 nt, synthetic construct
  misc_feature 1..699: note = derived and/or modified sequence opt1 from anti-HIV_3BQU_C-Chain
  source 1..699: mol_type = other RNA
atgaccatgttcagcctggccctcctgctgtccctcctgctgctctgcgtgagcgactccggcgccgagaccacggtgacccagagccccgcgtccctgagcatgtccatcggggagaaggtgaccatccgctgcatcaccagcacggacatcgacgacgacatgaactggtaccagcagaagccgggcgagccgccccggctgctcatctccgacgggaacaccctgcgccccggcgtgcccagccggttctccagctccgggtacggcaccgacttcgtcttcaccatcgagaacatgctgagcgaggacgtggccgactactactgcctccagtccgacaacctgccctacacgttcggcgggggcaccaacctggagatcaagcgcgccgacgccgcccccaccgtgagcatcttcccgccctccagcgagcagctcacctccgggggcgcgagcgtcgtgtgcttcctgaacaacttctaccccaaggacatcaacgtgaagtggaagatcgacgggagcgagcggcagaacggcgtcctgaactcctggacggaccaggacagcaaggactccacctacagcatgtccagcaccctcaccctgacgaaggacgagtacgagcgccacaactcctacacgtgcgaggccacccacaagaccagcacctcccccatcgtcaagagcttcaaccgg

SEQ ID NO: 11662 - RNA, 333 nt, synthetic construct
  misc_feature 1..333: note = derived and/or modified sequence opt1 from anti-HIV_Ig_LightChain
  source 1..333: mol_type = other RNA
gacgtggtcctgacccagagccccgcctccctcgccgtgagcctgggccagcgcgcgaccatctcctgcaaggccagccagtccgtggactacgacggggacagctacatgaactggtaccagcagaagcccggccagccgcccaagctgctcatccacgccgcctccaacctggtcagcgggatgcccgcccggttctccggcagcgggtccggcacggacttcaccctgaacatccaccccgtggaggaggaggacgcggccacctactactgccagcagagcatcgaggacccgcccaccttcggcgggggcacgaagctcgagatcaag

SEQ ID NO: 11663 - RNA, 342 nt, synthetic construct
  misc_feature 1..342: note = derived and/or modified sequence opt1 from anti-HIV_Ig_HeavyChain
  source 1..342: mol_type = other RNA
gacgtgcagctgcagcagagcggccccgggctcgtcaagccgtcccagagcctgtcccacacgtgcaccgtgaccggctacagcatcacctccgactacgcctggaactggatccgccagttccccgggaacaagctggagtggatgggctacatcagcttctccgggagcacctcctacaaccccagcctcaagtcccggatcagcatcacccgcgacacgtccaagaacctgttcttcctgcagctcaacagcgtgaccaccgaggacaccgccacgtactactgcgcgcggggcctgcccgactactggggccaggggaccaccctgaccgtctccagc

SEQ ID NO: 11664 - RNA, 1083 nt, synthetic construct
  misc_feature 1..1083: note = derived and/or modified sequence opt1 from anti-HIV_4P9H_G-Chain
  source 1..1083: mol_type = other RNA
gtgtggaaggacgccgacaccaccctgttctgcgccagcgacgcgaaggcccacgagacggagtgccacaacgtctgggccacccacgcctgcgtgcccaccgaccccaacccccaggagatccacctcgagcaggtcaccgagaacttcaacatgtggaagaacaacatggtggagcagatgcaggaggacgtgatctccctgtgggaccagtgcctgcagccctgcgtgaagctcacgggcgggagcgtcatcaagcaggcctgccccaagatctccttcgacccgatccccatccactactgcacccccgcgggctacgtgatcctgaagtgcaacgacaagaacttcaacgggaccggcccctgcaagaacgtgagctccgtccagtgcacccacgggatcaagccggtggtgagcacgcagctgctcctgaacggctccctggccgaggaggagatcatcatccgcagcgagaacctcaccaacaacgccaagaccatcatcgtccacctccagaagtccgtggagatcaactgcacccggcccagcaacggcgggtccggcagcgggggcgacatccgcaaggcctactgcgagatccaggggacgaagtggaacaaggtgctgaagcaggtcaccgagaagctgaaggagcacttcaacaacaagaccatcatcttccagccgccctccggcggcgacctggagatcaccatgcaccacttcaactgccgcggggagttcttctactgcaacacgacccagctgttccagaacacgtgcatcggcaacgagaccatgaaggggtgcaacggcaccatcaccctcccctgcaagatcaagcagatcatcaacatgtggcagggcaccgggcaggcgatgtacgccccgcccatcgacggcaagatcaactgcgtgagccagatcaccgggatcctgctgacgcgggacggcggggccaacaacacctccaacgagaccttccggcccggcggcgggaacatcaaggacaactggcgcagcgagctctacaagtacaaggtggtccagatcgagggctcccaccaccaccaccaccac

SEQ ID NO: 11665 - RNA, 147 nt, synthetic construct
  misc_feature 1..147: note = derived and/or modified sequence opt1 from anti-HIV_Chain
  source 1..147: mol_type = other RNA
caggtgcagctggtccagagcggcgggcagatgaagaagcccggcgagtccatgcgcatcagctgccgggcctccgggtacgagttcatcgactgcaccctcaactggatccgcctggccccgggcaagcggcccgagtggatgggg

SEQ ID NO: 11666 - RNA, 180 nt, synthetic construct
  misc_feature 1..180: note = derived and/or modified sequence opt1 from anti-HIV_Chain
  source 1..180: mol_type = other RNA
ccctgctgcttcgcctacatcgcccgcccgctgccccgggcgcacatcaaggagtacttctacaccagcggcaagtgctccaaccccgccgtggtcttcgtgacccgcaagaaccgccaggtgtgcgccaaccccgagaagaagtgggtccgggagtacatcaacagcctcgagatgtcc

SEQ ID NO: 11667 - RNA, 249 nt, synthetic construct
  misc_feature 1..249: note = derived and/or modified sequence opt1 from anti-HIV_Chain
  source 1..249: mol_type = other RNA
ctggagtggatgggccgcatcatcccggccatcgacgacgtgacctacgcccagaccttccgggggcgcgtcacgttcagcgcggacaagttcaccaccaccgcctacatggacctcacgggcctgcggtccgaggacaccgccacctacttctgcgcccgcgacccccaggtgaaccggcgcgggaactgcttcgaccactggggccaggggaccctggtgacggtcagctccgccagcaccaagggc

SEQ ID NO: 11668 - RNA, 270 nt, synthetic construct
  misc_feature 1..270: note = derived and/or modified sequence opt1 from anti-HIV_Chain
  source 1..270: mol_type = other RNA
gacgtggtcatgacccagagccccctgtccctcccggtgaccctgggccagcccgccagcatctcctgccgcagctcccagagcctggtgtactcccacggggacacgtacctcaagtgcttccagcagcggcccggccagagcccccgccggccgatctacaaggtctccaaccgcgacagcggggtgcccgaccggttctccggcagcgggtccggcaccgacttcaccctgaagatcagccgcgtggaggccgaggacgtcggcgtg

SEQ ID NO: 11669 - RNA, 294 nt, synthetic construct
  misc_feature 1..294: note = derived and/or modified sequence opt1 from anti-HIV_Chain
  source 1..294: mol_type = other RNA
agctccttcgccatcagctgggtgcgccaggcccccggccaggggctggagtggatgggcgggatcatcccgatcttcgaggcgacctcctacgcccagaagttccaggaccggctcaccatcacgaccgacgagagcaccaccacggcctacatggacctgtccagcctgcgctccgaggacaccgccgtctactactgcgcccgggcgcagggcgacatcctcaccgaggggtacttcgactactggggccagggcaccctggtgacggtgagctccgccagcaccaagggg

SEQ ID NO: 11670 - RNA, 297 nt, synthetic construct
  misc_feature 1..297: note = derived and/or modified sequence opt1 from anti-HIV_Chain
  source 1..297: mol_type = other RNA
aacaccttcaccagccactacgtgcactgggtccgccaggcccccggccaggggctggagtggatgggcatgatcaaccccgggggcacgacccggtacgccccgaagttccaggaccgcgtgaccctcacccgggacacgtccacccgcaccgtgtacatggagctgcggagcctgcgctccgaggacaccgcggtctactactgcgcccggccccagtacaacctcgggcgcgagcccctgaacgtgtggggccagggcacgatggtgaccgtcagctccgccagcaccaagggg

SEQ ID NO: 11671 - RNA, 297 nt, synthetic construct
  misc_feature 1..297: note = derived and/or modified sequence opt1 from anti-HIV_Chain
  source 1..297: mol_type = other RNA
atccgcagcttctactggcactggatccggcagtcccccggcaaggggctggagtggctcggcagcgtgttcgacaacgggctgaccacccacaacccgtccctcaagagccgcctgacgatctccgaggaccccagccggaaccagatctccctgaagctgcgcagcatgaccgccgccgacaccgcggtctactactgcgcccggggcgactacgacatcctcacctccagctaccagttcgactactgggggcagggcacgctggtggccgtgtccagcgcctccaccaagggc

SEQ ID NO: 11672 - RNA, 300 nt, synthetic construct
  misc_feature 1..300: note = derived and/or modified sequence opt1 from anti-HIV_Chain
  source 1..300: mol_type = other RNA
cagagcgccctgacccagcccgccttcgtgtccggcagcccggggcagtccatcaccctcagctgcacgctgggcaccgaggacgtctcctggtaccagcagcgccccaacagcgcgccccggctgatcatcttcgacgtgaagaagcgcccctccgacgtgagcgaccggttctccgggcacaacagcgacaccgccgccttcctcaccatctccgagctgcgcccggaggacgaggccgactacttctgcacgagctggccctaccggttcgaccgcggcaccaaggtcgacgtggcc

SEQ ID NO: 11673 - RNA, 300 nt, synthetic construct
  misc_feature 1..300: note = derived and/or modified sequence opt1 from anti-HIV_Chain
  source 1..300: mol_type = other RNA
cagagcgccctgacccagcccgccttcgtgtccggcagcccggggcagtccatcaccctcagctgcacgctgggcaccgaggacgtctcctggtaccagcagcgccccaacagcgcgccccggctgatcatcttcgacgtgaagaagcgcccctccgacgtgagcgaccggttctccgggcacaacagcgacaccgccgccttcctcaccatctccgagctgcgcccggaggacgaggccgagtacttctgcacgagctggccctaccggttcggccgcgggaccaaggtcgacgtggcc

SEQ ID NO: 11674 - RNA, 300 nt, synthetic construct
  misc_feature 1..300: note = derived and/or modified sequence opt1 from anti-HIV_Chain
  source 1..300: mol_type = other RNA
cagagcgccctgacccaccccgccttcgtgtccggcagcccggggcagtccatcaccctcagctgcacgctgggcaccgaggacgtctcctggtaccagcagcgccccaacagcgcgccccggctgatcatcttcgacgtgcgcaagcggccctccgaggtgagcgaccgcttctccgggcacaagagcgacaccgccgccttcctcaccatctccgacctgcggccggaggacgaggccgagtacttctgcacgagctggccctaccgcttcgaccggggcacccgcctggacgtcgcc

SEQ ID NO: 11675 - RNA, 300 nt, synthetic construct
  misc_feature 1..300: note = derived and/or modified sequence opt1 from anti-HIV_Chain
  source 1..300: mol_type = other RNA
cagagcgtgctgacccagcccgccttcgtctccggcagcccggggcagtccatcaccatcagctgcacggtgggcaccaccgacgtgtcctggtaccagcagcgccccaacagcgcgccccggctcatcatcttcgacgtcaagaagcgcccctccggggtgagcgaccggttctccggcagctccagcgacaacgccgccttcctgaccatcgccgggctgcgcccggaggacgaggccgagtactactgcacgtcctggccctaccggttcggccgcggcaccaaggtggacgtcggg

SEQ ID NO: 11676 - RNA, 300 nt, synthetic construct
  misc_feature 1..300: note = derived and/or modified sequence opt1 from anti-HIV_Chain
  source 1..300: mol_type = other RNA
cagagcgtgctgacccagcccgccttcgtctccgccagcccgggccagtccatcaccctcagctgcaacctggggacggactacgtgtcctggtaccagcagcgccccagctccgcgccccggctgatcatcttcgacgtgaagaaccgccccagcggcgtctccgaccggttcagcgggtacaactccgacaccgccgccttcctcaccatcagcggcctgcagccggaggacgaggccgagtactactgcacctcctggccctacaacttcgggcccggcacgaaggtggacgtgacc

SEQ ID NO: 11677 - RNA, 300 nt, synthetic construct
  misc_feature 1..300: note = derived and/or modified sequence opt1 from anti-HIV_Chain
  source 1..300: mol_type = other RNA
cagagcgtgctgacccagcccgcctccgtcagcggctccccggggcagagcatcaacatctcctgcgccggccgcagcgaccgggtgtcctggtaccagcagcgccccaacggggtgcccaagctcctgctgttcgacgtctaccggcgccccagcggcgtgtccgaccggttcagcgggtcccacagcgacgacaccgcgttcctcacgatctccggcctgcagaccgacgacgaggccgactactactgcaccagccacccgtacgccttcggccccgggaccaaggtgaacgtcctg

SEQ ID NO: 11678 - RNA, 300 nt, synthetic construct
  misc_feature 1..300: note = derived and/or modified sequence opt1 from anti-HIV_Chain
  source 1..300: mol_type = other RNA
cagagcgtgctgacccagcccgccttcgtctccggcagcccggggcagtccatcaccctcagctgcacgctgggcaccgaggacgtgtcctggtaccagcagcgccccaacagcgcgccccggctgatcatcttcgacgtgaagaagcgcccctccgacgtcagcgaccggttctccgggcacaacagcgacaccgccgccttcctcaccatctccgagctgcgcccggaggacgaggccgagtacttctgcacgagctggccctaccggttcggccgcgggaccaaggtggacgtggcc

SEQ ID NO: 11679 - RNA, 306 nt, synthetic construct
  misc_feature 1..306: note = derived and/or modified sequence opt1 from anti-HIV_Chain
  source 1..306: mol_type = other RNA
cagagcgccctgacccagcccgcctccgtgagcggctccccggggcagagcatcaccatctcctgcacggcggacagcgactacgtctcctggtaccagcagcgccccaacagcgcccccaagctcatcctgttcgacgtgaactcccggcccagcggcgtgtccgaccgctacagcgggtcccggagcggcaacaccgcctccctgaccatcagcgggctccagcgcgaggacgaggccgactacttctgcaccccgtggccctacgacttccggcccggcacgcgcgtcttcgtgctgggccag

SEQ ID NO: 11680 - RNA, 306 nt, synthetic construct
  misc_feature 1..306: note = derived and/or modified sequence opt1 from anti-HIV_Chain
  source 1..306: mol_type = other RNA
cagagcgccctgacccagcccgccttcgtgtccggcagcccggggcagtccatcaccctcagctgctccctgggcacggcggacgtcagctggtaccagcagcgccccaactccgcgccccggctgatcatcttcgacgtgaagaagcgccccagcgacgtgtccgaccggttcagcgggcacaactccgacaccgccgccttcgtcaccatcagcgagctccgcccggaggacgaggccgagtacttctgcacctcctggccctaccggttcggccccgggacgaaggtggacgtggcccgccag

SEQ ID NO: 11681 - RNA, 306 nt, synthetic construct
  misc_feature 1..306: note = derived and/or modified sequence opt1 from anti-HIV_Chain
  source 1..306: mol_type = other RNA
cagagcgtgctgacccagcccgcctccgtcagcggctccccggggcagaccatcagcatctcctgcagcggcacgttcgggtccgacagcgtgtcctggtaccagcagttccccaacagcgcccccaccctcatcatcttcgacgtgcaccgccggccctccggcatcagcacccgcttctccgggagcacctccggcgacacggcgagcctgaccatctccaccctgcaccgggaggacgaggccttctactactgcaccagccacccgtacgacttcggcgggggcacgtacgtcatcgtgctc

SEQ ID NO: 11682 - RNA, 306 nt, synthetic construct
  misc_feature 1..306: note = derived and/or modified sequence opt1 from anti-HIV_Chain
  source 1..306: mol_type = other RNA
cagagcgtgctgacccagcccgcctccgtcagcggctccccggggcagaccatcagcatctcctgcagcggcacgttcgggtccgacagcgtgtcctggtaccagcagtaccccaacagcgcccccaccctcatcatcttcgacgtgcaccgccggccctccggcatcagcacccgcttctccgggagcacctccggcgacacggcgagcctgaccatctccaccctgcaccgggaggacgaggcctactactactgcaccagccacccgtacgacttcggcgggggcacgtacgtcatcgtgctc

SEQ ID NO: 11683 - RNA, 306 nt, synthetic construct
  misc_feature 1..306: note = derived and/or modified sequence opt1 from anti-HIV_Chain
  source 1..306: mol_type = other RNA
cagagcgccctgacccagcccgcctccgtgagcggctccccggggcagagcatcaacatctcctgcgcgggccgcagcgaccgggtctcctggtaccagcagcgccccaacggggtgcccaagctcctgatgttcgacgtgtaccggcgccccagcggcgtctccgaccggttcagcgggtcccacagcggcgacaccgccttcctgacgatctccggcctccagaccgaggacgaggccgactactactgcaccagccacccgtacgccttcggggccggcaccaaggtgaacgtgctgcgccag

SEQ ID NO: 11684 - RNA, 306 nt, synthetic construct
  misc_feature 1..306: note = derived and/or modified sequence opt1 from anti-HIV_Chain
  source 1..306: mol_type = other RNA
gacatccagatgacccagagcccctccagcctgtccgccagcgtgggcgaccgcgtctccatccactgccaggccgggcagggcatcgggagctccctcaactggtaccagcagaagccgggccgggcgccccgcctgctggtgcacggggccagcaacctccagcggggcgtgccctcccgcttcagcggctccgggttccacaccacgttcaccctgaccatcagctccctgcagcccgacgacgtcgccacctactggtgcgccgccctcgagttcttcggcccggggacgaaggtggagatc

SEQ ID NO: 11685 - RNA, 309 nt, synthetic construct
  misc_feature 1..309: note = derived and/or modified sequence opt1 from anti-HIV_Chain
  source 1..309: mol_type = other RNA
gacatccagatgacccagagcccctccagcctgtccgccagcgtgggcgacaccgtcacgatcacgtgccaggccaacgggtacctcaactggtaccagcagcgccggggcaaggcgccgaagctgctgatctacgacgggtccaagctcgagcgcggcgtgcccagccggttctccgggcgccggtggggccaggagtacaacctgaccatcaacaacctgcagcccgaggacatcgccacctacttctgccaggtgtacgagttcgtcgtgcccggcacccgcctcgacctgaagcggaccgtggcc

SEQ ID NO: 11686 - RNA, 309 nt, synthetic construct
  misc_feature 1..309: note = derived and/or modified sequence opt1 from anti-HIV_Chain
  source 1..309: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgccgaagctgctgatctacgacgggagcaagctcgagcggggcgtgcccgcccgcttctccgggcggcgctggggccaggagtacaacctgaccatcaacaacctgcagcccgaggacgtggccacctacttctgccaggtctacgagttcatcgtgcccggcacccggctcgacctgaagcgcaccgtggcc

SEQ ID NO: 11687 - RNA, 309 nt, synthetic construct
  misc_feature 1..309: note = derived and/or modified sequence opt1 from anti-HIV_Chain
  source 1..309: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgccgaagctgctgatctacgacgggagcaagctcgagcggggcgtgccctcccgcttcagcgggcggcgctggggccaggagtacaacctgaccatcaacaacctgcagcccgaggacatcgccacctacttctgccaggtgtacgagttcgccgtccccggcacccggctcgacctgaagcgcaccgtggcc

SEQ ID NO: 11688 - RNA, 309 nt, synthetic construct
  misc_feature 1..309: note = derived and/or modified sequence opt1 from anti-HIV_Chain
  source 1..309: mol_type = other RNA
gacatccagatgacccagagcccctccagcctgtccgccagcgtgggcgacaccgtcacgatcacgtgccaggccaacgggtacctcaactggtaccagcagcgccggggcaaggcgccgaagctgctgatctacgacgggtccaagctcgagcgcggcgtgcccagccggttctccgggcgccggtggggccaggagtacaacctgaccatcaacaacctgcaggccgaggacatcgccacctacttctgccaggtgtacgagttcgccgtccccggcacccgcctcgacctgaagcggaccgtggcc

SEQ ID NO: 11689 - RNA, 309 nt, synthetic construct
  misc_feature 1..309: note = derived and/or modified sequence opt1 from anti-HIV_Chain
  source 1..309: mol_type = other RNA
gacatccagatgacccagagcccctccagcctgtccgccagcgtgggcgacaccgtcacgatcacgtgccaggccaacgggtacctcaactggtaccagcagcgccggggcaaggcgccgaagctgctgatctacgacgggtccaagctcgagcgcggcgtgcccagccggttctccgggcgccggtggggccaggagtacaacctgaccatcaacaacctgcagcccgaggacatcgccacctacttctgccaggtgtacgagttcatcgtccccggcacccgcctcgacctgaagcggaccgtggcc

SEQ ID NO: 11690 - RNA, 309 nt, synthetic construct
  misc_feature 1..309: note = derived and/or modified sequence opt1 from anti-HIV_Chain
  source 1..309: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgccgaagctgctgatctacgacgggagcaagctcgagaccggcgtgccctcccggttcaccgggcgccggtggggccaggagtacaacctgaccatcaacaacctgcagcccgaggacatcgccacctacttctgccaggtgtacgagttcatcgtccccggcacccgcctcgacctgaagcggaccgtggcc

SEQ ID NO: 11691 - RNA, 312 nt, synthetic construct
  misc_feature 1..312: note = derived and/or modified sequence opt1 from anti-HIV_Chain
  source 1..312: mol_type = other RNA
gacatccagatgacccagagcccctccagcctgtccgccagcgtgggcgacaaggtcaccatcacgtgccagacctccgccgggtacctcaactggtaccagcagcgccggggccgcgcgccgaagctgctgatgtacgacgggagccggctcgtgaccggcgtgccctcccgcttcagcgggcggcgctggggcacccagtacaacctgacgatcggctccctgcagcccgaggacgtcgccacctactactgccaggtgtacgagttcttcgggcccggcacccggctcgacctgaagcgcaccgtggcc

SEQ ID NO: 11692 - RNA, 312 nt, synthetic construct
  misc_feature 1..312: note = derived and/or modified sequence opt1 from anti-HIV_Chain
  source 1..312: mol_type = other RNA
gacatccagatgacccagagcccctccagcctgtccgccagcgtgggcgacaaggtcaccatcacgtgccagacctccgccgggtacctgaactggtaccagcagcgccggggccgcgcgccgaagctgctgatgtacgacgggagccggctcgtgaccggcgtgccctcccgcttcagcgggcggcgctggggcacccagtacaacctgacgatcggctccctgcagcccgaggacatcgccacctactactgccaggtctacgagttcttcgggcccggcacccggctcgacctcaagagcaccgtggcc

SEQ ID NO: 11693 - RNA, 312 nt, synthetic construct
  misc_feature 1..312: note = derived and/or modified sequence opt1 from anti-HIV_Chain
  source 1..312: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgccgaagctgctgatctacgacgggagcaagctcgagcggggcgtgcccgcccgcttctccgggcggcgctggggccaggagtacaacctgaccatcaacaacctgcagcccgaggacgtggccacctacttctgccaggtctacgagttcatcgtgcccggcacccggctcgacctgaagcgcaccgtggccgcc

SEQ ID NO: 11694 - RNA, 312 nt, synthetic construct
  misc_feature 1..312: note = derived and/or modified sequence opt1 from anti-HIV_Chain
  source 1..312: mol_type = other RNA
tgcaccgtgagcggcgggtccatcatcagctactactggaactggatccgccagtcccccggcaaggggctggagtggctcggctacatcttcgacgggggccgggccaactacaacccgagcctgcgctcccggctgaccatgagcgtcgacacgtccaagaaccagatcagcctcaaggtgaagtccgtgaccgccgcggacagcgccatctactactgcgcccgcctggacggcgaggccttccggtactacttcgactcctgggggcagggcaccctggtcaccgtgagctccgccagcacgaagggg

SEQ ID NO: 11695 - RNA, 312 nt, synthetic construct
  misc_feature 1..312: note = derived and/or modified sequence opt1 from anti-HIV_Chain
  source 1..312: mol_type = other RNA
gtgagcggcgggcgcttctccaactacggcctgagctgggtccggcaggcccccgggcagggcctcgagtggatggggcgcatcgtgccggccatcaaccgggcgaagtacgcccagaagttccagggccgcgtgatcctgaccgccgacaagatcaccgacacggcctacatggagctgcggtccctccgcagcgaggacaccgccatcttctactgcgcgcgggacccccagatcgagatccgcggcaacgccttcgacatctgggggcagggcaccgtcgtgaccgtgtccagcgcctccacgaagggg

SEQ ID NO: 11696 - RNA, 315 nt, synthetic construct
  misc_feature 1..315: note = derived and/or modified sequence opt1 from anti-HIV_Chain
  source 1..315: mol_type = other RNA
agcgacatctccgtggcccccggcgagaccgcccgcatcagctgcggggagaagtccctgggcagccgggcggtccagtggtaccagcaccgcgccgggcaggccccgtccctcatcatctacaacaaccaggaccggcccagcggcatccccgagcgcttctccgggagccccgactccccgttcggcaccacggccaccctgaccatcaccagcgtggaggccggcgacgaggcggactactactgccacatctgggactcccgggtgcccacgaagtgggtcttcgggggcgggaccaccctgaccgtgctc

SEQ ID NO: 11697 - RNA, 315 nt, synthetic construct
  misc_feature 1..315: note = derived and/or modified sequence opt1 from anti-HIV_Chain
  source 1..315: mol_type = other RNA
agctccatgagcgtgtcccccggcgagaccgccaagatcagctgcgggaaggagtccatcggcagccgcgccgtccagtggtaccagcagaagtccgggcagccgcccagcctgatcatctacaacaaccaggaccggccctccggcgtgcccgagcgcttcagcgcgaccccggacttcggggccggcacgaccgccaccctcaccatcacgaacgtggaggccgacgacgaggccgactactactgccacatctacgacgcgcggggcgggaccaactgggtcttcgaccgcggcgccaccctgaccgtgctg

SEQ ID NO: 11698 - RNA, 315 nt, synthetic construct
  misc_feature 1..315: note = derived and/or modified sequence opt1 from anti-HIV_Chain
  source 1..315: mol_type = other RNA
agcttcgtgtccgtcgcccccggccagaccgcccgcatcacgtgcggggaggagagcctgggctcccggagcgtgatctggtaccagcagcgcccggggcaggcgccctccctcatcatctacaacaacaacgaccggcccagcggcatccccgagcgcttctccgggagcccgggctccaccttcggcaccaccgccaccctgacgatcaccagcgtggaggccggggacgaggccgactactactgccacatctgggactcccggcgccccaccaactgggtcttcggcgaggggaccacgctgaccgtgctc

SEQ ID NO: 11699 - RNA, 315 nt, synthetic construct
  misc_feature 1..315: note = derived and/or modified sequence opt1 from anti-HIV_Chain
  source 1..315: mol_type = other RNA
agcttcgtgtccgtcgcccccggccagaccgcccgcatcacgtgcggggaggagagcctgggctcccggagcgtgatctggtaccagcagcgcccggggcaggcgccctccctcatcatgtacaacaaccacgaccggcccagcggcatccccgagcgcttctccgggagcccgggctccaccttcggcaccaccgccaccctgacgatcaccagcgtggaggccggggacgaggccgactactactgccacatctgggactcccggcgccccaccaactgggtcttcggcgaggggaccacgctgaccgtgctc

SEQ ID NO: 11700 - RNA, 315 nt, synthetic construct
  misc_feature 1..315: note = derived and/or modified sequence opt1 from anti-HIV_Chain
  source 1..315: mol_type = other RNA
gacatccagatgacccagagcccctccagcctgtccgccagcgtgggcgacaaggtcaccatcacgtgccagacctccgccgggtacctgaactggtaccagcagcgccggggccgcgcgccgaagctgctgatgtacgacgggagccggctcgtgaccggcgtgccctcccgcttcagcgggcggcgctggggcacccagtacaacctgacgatcggctccctgcagcccgaggacatcgccacctactactgccaggtctacgagttcttcgggcccggcacccggctcgacctcaagagcaccgtggccgcc

SEQ ID NO: 11701 - RNA, 315 nt, synthetic construct
  misc_feature 1..315: note = derived and/or modified sequence opt1 from anti-HIV_Chain
  source 1..315: mol_type = other RNA
gacatccagatgacccagagcccctccagcctgtccgccagcgtgggcgaccgcgtctccatcaactgccaggccgggcagggcctcgggagctccctgaactggtaccagcagaagccgggccgggcgcccaagctgctcgtgcacggggccagcaacctgcagcgcggcgtgccctcccggttcagcggctccgggttccacaccacgttcaccctgaccatcagctccctccagcccgacgacgtcgccacctacttctgcgccgccttccagtggttcggcccggggacgaaggtggagatcaagcgcacc

SEQ ID NO: 11702 - RNA, 318 nt, synthetic construct
  misc_feature 1..318: note = derived and/or modified sequence opt1 from anti-HIV_Chain
  source 1..318: mol_type = other RNA
tgcaccgtgagcggcgggtccatcagctccgccggctactactggacctggatccgccagcaccccgggaagggcctggagttcatcgggtacatctactacatcggcacgacctactacaacccgagcctcaagtcccggctgaccatcagcatcgacacctccaagaaccagttcagcctgaagctctccagcgtcacggccgcggacaccgccatctactactgcgcccgcgactacaccgcccggggccgccacttcttcgactactgggggcagggcgccctggtgaccgtgtccagcgcgtccacgaagggg

SEQ ID NO: 11703 - RNA, 321 nt, synthetic construct
  misc_feature 1..321: note = derived and/or modified sequence opt1 from anti-HIV_Chain
  source 1..321: mol_type = other RNA
agctccctgcccctcagcctggccccgggcgccaccgcgaagatcccctgcggggagaagtcccgcggcagccgggccgtgcagtggtaccagcagaagcccgggcaggcccccaccctgatcatctacaacaaccaggaccgcccggccggcgtctccgagcggtacagcgggaaccccgacgtggccatcggcgtgacggcgaccctcaccatctcccgcgtcgaggccggcgacgaggccgagtactactgccactactgggacagccggtcccccatcagctgggtgttcgggggctggacccagctgacggtgctg

SEQ ID NO: 11704 - RNA, 321 nt, synthetic construct
  misc_feature 1..321: note = derived and/or modified sequence opt1 from anti-HIV_Chain
  source 1..321: mol_type = other RNA
agctccctgcccctcagcgtggccccgggcgccaccgcgaagatcgcctgcggggagaagtccttcgccagccgcgccgtccagtggtaccagcagaagcccggccaggcccccgtgctgatcatctacaacaaccaggaccggcccgcgggggtgtccgagcgcttcagcggcaccccggacgtcgggttcggctccacggccaccctgaccatcagccgggtggaggccggcgacgaggccgactactactgccacaagtgggactcccgcagccccctctcctgggtgttcgggggcgggacccagctgacggtcctg

SEQ ID NO: 11705 - RNA, 321 nt, synthetic construct
  misc_feature 1..321: note = derived and/or modified sequence opt1 from anti-HIV_Chain
  source 1..321: mol_type = other RNA
gacatccagatgacccagagcccctccagcctgtccgccagcatcggcgaccgcgtgaccatcacgtgccgggcctcccaggacatcgcgaactacctcaactggtaccagaagaagtccgggaccccgcccaagctgctgatcttcgccgccaccaacctccaccgcggcgtcagcccccggttcaccgggagcggccacgggacgcacttctccctgaccatcaccaacgtgcagcacgaggacttcggcaactacttctgccagcagagcttcgccaccgtgggctccttcgggcagggcacgtgggtcgacatccgc

SEQ ID NO: 11706 - RNA, 321 nt, synthetic construct
  misc_feature 1..321: note = derived and/or modified sequence opt1 from anti-HIV_Chain
  source 1..321: mol_type = other RNA
gacatccagatgacccagagcccctccagcctgtccgccagcatcggcgaccgcgtgaccatcacgtgccgggcctcccaggacatcgcgaactacctcaactggtaccagaagaagtccgggaccccgcccaagctgctgatcttcgccgccaccaacctccaccgcggcgtcagcccccggttcaccgggagcggccacgggacgcacttctccctgaccatcaccaacgtgcagcacgaggacttcggccactacttctgccagcagagcttcgccaccgtgggctccttcgggcagggcacgtgggtcgacatccgc

SEQ ID NO: 11707 - RNA, 321 nt, synthetic construct
  misc_feature 1..321: note = derived and/or modified sequence opt1 from anti-HIV_Chain
  source 1..321: mol_type = other RNA
gacatccagatgacccagagcccctccagcctgtccgccagcgtgggcgaccgcgtcaccatcacgtgccgggcctcccaggacatcgcgaactacctcaactggtaccagaagaagtccgggaccccgcccaagctgctgatcttcgccgccaccaacctccaccgcggcgtgagcccccggttcagcgggtccggcagcgggacccacttctccctgacgatcaccaacgtgcagtacgaggacttcgccaactacttctgccagcacagcttcggcaccatcggcaccttcgggcagggcacgtgggtcgacatccgc

SEQ ID NO: 11708 - RNA, 321 nt, synthetic construct
  misc_feature 1..321: note = derived and/or modified sequence opt1 from anti-HIV_Chain
  source 1..321: mol_type = other RNA
gacatccagatgacccagagcccctccagcctgtccgccagcatcggcgaccgcgtgaccatcacgtgccgggcctcccaggacatcgcgaactacctcaactggtaccagaagaagtccgggaccccgcccaagctgctgatcttcggcgccaccaacctccaccacggggtcagcccccgcttcagcggctccgggcacggcacccacttcagcctgacgatcaccaacgtgcagcacgaggacttcgccaactacttctgccagcagtccttccagaccgtgggcagcttcgggcagggcacctgggtcgacatccgg

SEQ ID NO: 11709 - RNA, 321 nt, synthetic construct
  misc_feature 1..321: note = derived and/or modified sequence opt1 from anti-HIV_Chain
  source 1..321: mol_type = other RNA
gagatcgtgctgacccagagccccgccaccctctccctgagcccgggcgagacggccatcatctcctgccgcaccagccagtccgggagcctggcgtggtaccagcagcggcccggccaggcgccccgcctcgtcatctactccgggagcacccgggccgccggcatccccgaccgcttctccgggagccggtggggcgccgactacaacctgtccatcagcaacctggagtccggcgacttcggggtgtactactgccagcagtacgagttcttcggccaggggaccaaggtgcaggtcgacatcaagcgcacggtggcc

SEQ ID NO: 11710 - RNA, 321 nt, synthetic construct
  misc_feature 1..321: note = derived and/or modified sequence opt1 from anti-HIV_Chain
  source 1..321: mol_type = other RNA
gacatccagatgacccagagcccctccagcctgtccgccagcatcggcgaccgcgtgaacatcacgtgccaggcctcccgggacaccgggagcgcgctcaactggtaccagcagaaggtcggccgcccgccccggctgctgatctccgccgtgagcaacctcggggccggcgtgccctcccgcttcagcgggcggcgctccggcacccagagcaccctgaccatcaacacgctgcagcccgaggacatcgccacctacttctgccagcactacgagttcttcggcccggggaccaaggtcgacatcaagcggaccgtggcc

SEQ ID NO: 11711 - RNA, 321 nt, synthetic construct
  misc_feature 1..321: note = derived and/or modified sequence opt1 from anti-HIV_Chain
  source 1..321: mol_type = other RNA
gacatccagatgacccagagcccctccagcctgtccgccagcgtgggcgaccgcgtcaccatcacgtgccaggccgggcagggcatcgggtccagcctccagtggtaccagcagaagccgggcaaggcgcccaagctgctggtgcacggggcctccaacctccaccggggcgtgcccagccgcttctccggcagcgggttccacaccaccttctccctgaccatcagcggcctgcagcgggacgacttcgccacgtacttctgcgccgtcctcgagttcttcgggcccggcaccaaggtggagatcaagcgcaccgtggcc

SEQ ID NO: 11712 - RNA, 324 nt, synthetic construct
  misc_feature 1..324: note = derived and/or modified sequence opt1 from anti-HIV_Chain
  source 1..324: mol_type = other RNA
agctacgtgcgccccctgtccgtcgccctcggcgagaccgccagcatctcctgcgggcggcaggcgctgggcagccgcgccgtgcagtggtaccagcaccggccggggcaggcccccatcctgctcatctacaacaaccaggaccgcccctccggcatccccgagcggttcagcgggaccccggacatcaacttcggcacgcgcgccaccctgaccatctccggcgtggaggccggggacgaggcggactactactgccacatgtgggacagccggtccggcttcagctggtccttcgggggcgccacccgcctgacggtcctc

SEQ ID NO: 11713 - RNA, 324 nt, synthetic construct
  misc_feature 1..324: note = derived and/or modified sequence opt1 from anti-HIV_LightChain
  source 1..324: mol_type = other RNA
gacatcctgatgacccagagcccctccctcctgagcgcctccgtgggcgaccgcgtcaccatcacgtgcaaggccagccaggacgtgtccaccgcggtggcctggtaccagcagaagccggggaaggcccccaagctgctcatctactgggccagcacccggcacaccggcgtcccctcccgcttcacggggagcggctccgggaccgacttcaccctgaccatcagccggctgcaggccgaggacttcgcgctctactactgccagcagcactacacgaccccctggaccttcggcggcgggaccaaggtggagatcaagcgc

SEQ ID NO: 11714 - RNA, 324 nt, synthetic construct
  misc_feature 1..324: note = derived and/or modified sequence opt1 from anti-HIV_LightChain
  source 1..324: mol_type = other RNA
gacatcgtgatgacccagagcccctccctgctcagcgcctccgtcggcgaccgcgtgaccatcacgtgcaaggccagccaggacgtgtccaccgcggtcgcctggtaccagcagaagccggggaaggcccccaagctgctgatctactgggccagcacccggcacaccggcgtgccctcccgcttcagcgggtccggcagcgggacggacttcaccctcaccatctccagcctgcagcccgaggacttcgccctgtactactgccagcagcactacaccacgccgtggaccttcggcggcgggaccaaggtggagatcaagcgg

SEQ ID NO: 11715 - RNA, 324 nt, synthetic construct
  misc_feature 1..324: note = derived and/or modified sequence opt1 from anti-HIV_Chain
  source 1..324: mol_type = other RNA
gacatccagatgacccagagcccctccagcctgtccgccagcgtgggcgacaccgtcacgatcaactgccagaccaacaaggggtacctcaactggtaccagcagcgccggggccgcgccccgaagctgctgatgtacgacgggtccaagctcgtgaccggcgtgcccagccggttctccgggcgccggtggggcacccagtacaacctgacgatcggcagcctgcagcccgaggacatcgcgacctactactgccaggtctacgagttcttcgggcccggcacccgcctcgacctgaagcggaccgtggccgccccgtccgac

SEQ ID NO: 11716 - RNA, 333 nt, synthetic construct
  misc_feature 1..333: note = derived and/or modified sequence opt1 from anti-HIV_Chain
  source 1..333: mol_type = other RNA
ctgagcgcctacgtgggcgaccgcgtcaccatcacgtgccgggcctcccagaacatcaacacctacctcaactggtaccagcagcgccccgggaaggcgccgaagctgctgatctacgccgccagcaccctccagtccggcgtgcccagccggttctccgggagcggctccgggaccgacttcaccctgacgatcagcaacctggagaccgaggacttcgccgtgtactactgccagcagacctactccagcgtcaccttcggccagggcacgaagctcgagacccgccggaccgtggccgcgccctccgtgttcatcttcccgcccagcgac

SEQ ID NO: 11717 - RNA, 333 nt, synthetic construct
  misc_feature 1..333: note = derived and/or modified sequence opt1 from anti-HIV_Chain
  source 1..333: mol_type = other RNA
gagatcgtgctgacccagagccccgccaccctctccctgagcccgggcgagcgcgccacgctgtcctgccgggcgagccagggggtcaacttcgtggtgtggtaccagcagaagcgcggccaggcgccccggctcctgatctacgggaactccgaccgcgtccccggcgtgcccgaccggttcagcgcccgcgggtccggcaccgagttcagcctggtgatctccagcgtcgagccggacgacttcgccctctactactgccaggagtactccagcaccccctacaacttcggccccgggacccgggtggaccgcaagcggacggtggccgcc

SEQ ID NO: 11718 - RNA, 336 nt, synthetic construct
  misc_feature 1..336: note = derived and/or modified sequence opt1 from anti-HIV_HeavyChain
  source 1..336: mol_type = other RNA
gaggtgaagctggaggagagcggcgggggcctcgtccagcccgggggctcccgcaagctgagctgcgccgcctccgggttcaccttcagctccttcggcatgcactgggtgcggcaggcgccggagaagggcctggagtgggtggcctacatcagctccgggagctccaccctccactacgccgacacggtcaagggccgcttcaccatcagccgggacaaccccaagaacaccctgttcctgcagatgaagctcccctccctgtgctacgggctgctcggcagccgcaacctgtcccaccggctgctcagccagaacgacacccccatctgcctg

SEQ ID NO: 11719 - RNA, 336 nt, synthetic construct
  misc_feature 1..336: note = derived and/or modified sequence opt1 from anti-HIV_Chain
  source 1..336: mol_type = other RNA
gagatcgtgctgacccagagccccgccaccctctccctgagcccgggcgagcgcgccacgctgtcctgccgggcgagccagggggtcaacttcgtggtgtggtaccagcagaagcgcggccaggcgccccggctcctgatctacgggccctccgaccgcgcccccggcgtcccggaccggttcagcgcccgcgggtccggcaccgagttcagcctggtgatctccagcgtggagcccgacgacttcgccctctactactgccaggagtactccagcaccccctacaacttcggcaccgggacgcgggtcgaccgcaagcggaccgtggccgccccc

SEQ ID NO: 11720 - RNA, 336 nt, synthetic construct
  misc_feature 1..336: note = derived and/or modified sequence opt1 from anti-HIV_Chain
  source 1..336: mol_type = other RNA
cagaccctgagcctgacctgctccgtgagcggcgggtccatcagctccgccggctactactgggggtggatccgccagcaccccggcaaggggctggagtggatcggccacatctactacagcggcaacacgaactacaacccgtccctcaagagccggctctccatgagcgtcgagacctccaagaaccagttcagcctgaacctggcctccgtgaccgcggccgacaccgccgtgtacttctgcgcccgcgactacagcgccgcggggcggcacctcttcgactcctggggccaggggatcctggtcacggtgagctccgccagcaccaagggc

SEQ ID NO: 11721 - RNA, 336 nt, synthetic construct
  misc_feature 1..336: note = derived and/or modified sequence opt1 from anti-HIV_LightChain
  source 1..336: mol_type = other RNA
gacatcgtgatgacccagcagacgcccctgaccctcagcatcaccatcggccagccggcctccatcagctgcaagtccagccagtccctgctggacagcgacgggaagacctacctcaactggctgctgcagcgccccggccagtcccccaagcggctcatctactggatgagcaagctggactccggggtccccgaccgcttcaccggcagcgggtccggcacggacttcaccctgaagatcagccgggtggaggccgaggacctcggcgtgtactactgctggcaggggacccacttcccgtggaccttcggcgggggcacgaagctggagctg

SEQ ID NO: 11722 - RNA, 339 nt, synthetic construct
  misc_feature 1..339: note = derived and/or modified sequence opt1 from anti-HIV_LightChain
  source 1..339: mol_type = other RNA
gacatcgtgatcacccagagcaccaagttcatgtccacgagcgtcggcgaccgcgtgtccatcacgtgcaaggccagccaggacgtgtccaccgccgtcgcgtggtaccagcagaagcccgggcagagcccgaagctgctcatctactgggcctccacccggcacaccggcgtgcccgaccgcttcaccgggagcggctccgggaccgactacaccctgacgatcagccgggtgcaggccgaggacctggccctctactactgccagcagcactacaccaccccctggaccttcggcggcgggacgaagctggagatcaagcgcaccgtcgccgcgccc

SEQ ID NO: 11723 - RNA, 339 nt, synthetic construct
  misc_feature 1..339: note = derived and/or modified sequence opt1 from anti-HIV_Chain
  source 1..339: mol_type = other RNA
gacatccagatgacccagagcccctccagcctgtccgcccgcgtgggcgacaccgtcacgttcacgtgccaggccaacgggtacctcaactggtaccagcagcggcgcggcaaggcgccgaagctgctgatctacgacgggagcaagctcgagcggggcgtgccctcccgcttcagcgggcggcgctggggccaggagtacaacctgaccatcaacaacctgcagcccgaggacatcgccacctacttctgccaggtgtacgagttcgccgtccccggcacccggctcgacctgaagcgcaccgtggccgccccgtccgtgttcatcttccccagcgac

SEQ ID NO: 11724 - RNA, 339 nt, synthetic construct
  misc_feature 1..339: note = derived and/or modified sequence opt1 from anti-HIV_Chain
  source 1..339: mol_type = other RNA
cagagcgtgctgacccagcccgcctccgtcagcggctccccggggcagagcatcaccatctcctgcacgggcaccaacagcgacgtggggtactcctacgtgagctggttccagcagcaccccggcaaggtccccaagctcctgatctacgacgtgtcccgccggagctccggggtgagcaaccgcttctccggcagccggtccggcaacaccgccagcctgaccatctccgggctccgcgcggaggacgaggccgactactactgcggcagcttcacgacctccctgaccctggtcttcgggggcgggaccaagctcgccgtgctggtgagccccagc

SEQ ID NO: 11725 - RNA, 339 nt, synthetic construct
  misc_feature 1..339: note = derived and/or modified sequence opt1 from anti-HIV_Chain
  source 1..339: mol_type = other RNA
agcctgtccgccagcgtgggcgaccgcgtcaccatcacgtgccgggcctccgagagcatctccttctacctcaactggtaccagcagaagcccgggaaggcgccggagctgctgatcttcgccaccagcaccctccactccggcgtgcccagccgcttctccgggagcggctccgggaccgacttcaccctgacgatcagctccctgcagctcgaggacttcgccacctactactgccagcagagctccagcacccccttcaccttcggcggcgggacgaaggtggagatcaagcggaccgtcgccgccccctccgtgttcatcttcccgcccagcgac

SEQ ID NO: 11726 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgccagcgtgggcgacaccgtcacgatcacgtgccaggccaacgggtacctcaactggtaccagcagcgccggggcaaggcgcccaagctgctgatctacgacgggtccaagctcgagcgcggcgtgcccagccggttctccgggcgccggtggggccaggagtacaacctgaccatcaacaacctgcagcccgaggacatcgccacctacttctgccaggtgtacgagttcatcgtccccggcacccgcctcgacctgaagcggaccgtggccgccccgagcgtgttcatcttcccgccctccgac

SEQ ID NO: 11727 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgcccaagctgctgatctacgacgggagcaagctcgagcggggcgtgccctcccgcttcagcgggcggcgctggggccaggagtacaacctgaccatcaacaacctgcagcccgaggacatcgccacctacttctgccaggtgtacgagttcgccgtccccggcacccggctcgacctgaagcgcaccgtggccgccccgtccgtgttcatcttcccgcccagcgac

SEQ ID NO: 11728 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgcccaagctgctgatctacgacgggagcaagctcgagcggggcgtgccctcccgcttcagcgggcggcgctggggccaggagtacaacctgaccatcaacaacctgcagcccgaggacatcgccacctacttctgccaggtgtacgagttcgtcgtgcccggcacccggctcgacctgaagcgcaccgtggccgccccgtccgtcttcatcttcccgcccagcgac

SEQ ID NO: 11729 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgcccgcgtgggcgacaccgtcacgttcacgtgccaggccaacgggtacctcaactggtaccagcagcggcgcggcaaggcgcccaagctgctgatctacgacgggagcaagctcgagcggggcgtgccctcccgcttcagcgggcggcgctggggccaggagtacaacctgaccatcaacaacctgcagcccgaggacatcgccacctacttctgccaggtgtacgagttcgccgtccccggcacccggctcgacctgaagcgcaccgtggccgccccgtccgtgttcatcttcccgcccagcgac

SEQ ID NO: 11730 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgccagcgtgggcgacaccgtcacgatcacgtgccaggccaacgggtacctcaactggtaccagcagcgccggggcaaggcgcccaagctgctgatgtacgacgggtccaccctcgagcgcggcgtgcccgcccggttcagcgggcgccggtggggccaggagtacaacctgaccatcaacaacctgcagcccgaggacgtggccacctacttctgccaggtctacgagttcatcgtgcccggcacccgcctcgacctgaagcggaccgtggccgccccgtccgtcttcatcttcccgcccagcgac

SEQ ID NO: 11731 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgccagcgtgggcgacaccgtcacgatcacgtgccaggccaacgggtacctcaactggtaccagcagcgccggggcaaggcgccgaagctgctgatctacgacgggtccaagctcgagcgcggcgtgcccagccggttctccgggcgccggtggggccaggagtacaacctgaccatcaacaacctgcaggccgaggacatcgccacctacttctgccaggtgtacgagttcgccgtccccggcacccgcctcgacctgaagcggaccgtggccgcgcccagcgtgttcatcttcccgccctccgac

SEQ ID NO: 11732 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgccagcgtgggcgacaccgtcacgttcacgtgccaggccaacgggtacctcaactggtaccagcagcgccggggcaaggcgcccaagctgctgatctacgacgggtcccgcctcgagcggggcgtgcccagccgcttctccgggcggcgctggggccaggagtacaacctgaccatcaacaacctgcagcccgaggacatcgccacctacttctgccaggtgtacgagttcgccgtccccggcacccggctcgacctgaagcgcaccgtggccgccccgagcgtgttcatcttcccgccctccgac

SEQ ID NO: 11733 - RNA, 342 nt, synthetic construct
  misc_feature 1..342: note = derived and/or modified sequence opt1 from anti-HIV_Chain
  source 1..342: mol_type = other RNA
gacatccagatgacccacagcccctccagcctgtccgccagcgtgggcgacaccgtcacgatcacgtgccaggccaacgggtacctcaactggtaccagcagcgccggggcaaggcgcccaagctgctgatctacgacgggtccaagctcgagaccggcgtgcccagccgcttcaccgggcggcgctggggccaggagtacaacctgaccatcaacaacctgcagcccgaggacatcgccacctacttctgccaggtgtacgagttcatcgtccccggcacccggctcgacctgaagcgcaccgtggccgccccgtccgtgttcatcttcccgcccagcgac

SEQ ID NO: 11734 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgcccaagctgctgatctacgacgggagcaagctcgagaccggcgtgccctcccggttcaccgggcgccggtggggccaggagtacaacctgaccatcaacaacctgcagcccgaggacatcgccacctacttctgccaggtgtacgagttcatcgtccccggcacccgcctcgacctgaagcggaccgtggccgccccgagcgtgttcatcttcccgccctccgac

SEQ ID NO: 11735 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgcccgcgtgggcgacaccgtcacgttcacgtgccaggccaacgggtacctcaactggtaccagcagcggcgcggcaaggcgcccaagctgctgatctacgacgggagcaagctcgagcggggcgtgccctcccgcttcagcgggcggggctggggccaggagtacaacctgaccatcaacaacctgcagcccgaggacatcgccacctacttctgccaggtgtacgagttcgccgtccccgggacccgcctcgacctgaagcggaccgtggccgccccgtccgtgttcatcttcccgcccagcgac

SEQ ID NO: 11736 - RNA, 342 nt, synthetic construct
  misc_feature 1..342: note = derived and/or modified sequence opt1 from anti-HIV_Chain
  source 1..342: mol_type = other RNA
gacatccagatgacccagagcccctccagcctgtccgccagcgtgggcgacaccgtcacgatcacgtgccaggccaacgggtacctcaactggtaccagcagcgccggggcaaggcgcccaagctgctgatctacgacgggtccaagctcgagcgcggcgtgcccagccggttctccgggcgccggtggggccaggagtacaacctgaccatcaacaacctgcagcccgaggacatcgccacctacttctgccaggtgtacgagttcgtcgtgcccggcacccgcctcgacctgaagcggaccgtggccgccccgagcgtcttcatcttcccgccctccgac

SEQ ID NO: 11737 - RNA, 342 nt, synthetic construct
  misc_feature 1..342: note = derived and/or modified sequence opt1 from anti-HIV_Chain
  source 1..342: mol_type = other RNA
agccagtccgtggtcacccaggagcccagcctgaccgtgtccccgggcgggacggtgaccctgacctgcggccccagcaccggggccgtcacgtccggcttctacccccactggttccagcagaagcccgggcaggccccgcgcgcgctcatctacagcacctccaacaagtacagctggacccccgcccggttctccggcagcctgctcggcgggaaggccgtgctgaccctgtccgacgtgcagcccgacgacgaggccgagtactactgcctcctgctgctctactacggcgggccctggatcttcggcgggggcacgaagctgaccgtcctggtgagc

SEQ ID NO: 11738 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaaggtcaccatcacgtgccagacctccgccgggtacctcaactggtaccagcagcgccggggccgcgcgcccaagctgctgatgtacgacgggagccggctcgtgaccggcgtgccctcccgcttcagcgggcggcgctggggcacccagtacaacctgacgatcggctccctgcagcccgaggacgtcgccacctactactgccaggtgtacgagttcttcgggcccggcacccggctcgacctgaagcgcaccgtggccgccccgagcgtcttcatcttcccgccctccgac

SEQ ID NO: 11739 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcacgtgccagaccaccaaggggtacctcaactggtaccagcagcgccggggccgcgcccccaagctgctgatgttcgacgggtccaagctcgtgaccggcgtgcccagccggttctccgggcgccggtggggcacccagtacaacctgaccatcggcagcctgcagcccgaggacctcgcgacctactactgccaggtctacgagttcttcgggcccggcacgcgcctggacctgaagcggaccgtggccgccccgtccgtgttcatcttcccgcccagcgac

SEQ ID NO: 11740 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcacgtgccagaccaacaaggggtacctcaactggtaccagcagcgccggggccgcgcccccaagctgctgatgtgcgacgggtccaagctcgtgaccggcgtgcccagccggttctccgggcgccggtggggcacccagtacaacctgaccatcggcagcctgcagcccgaggacatcgcgacctactactgccaggtctacgagttcttcgggcccggcacccgcctcgacctgaagcggacggtggccgccccgtccgtgttcatcttcccgcccagcgac

SEQ ID NO: 11741 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgcccgcgtgggcgacaaggtcaccatcacgtgccagaccagcgccgggtacctcaactggtaccagcagcggcgcggccgggcgcccaagctgctgatgtacgacgggtcccgcctcgtgaccggcgtgcccagccggttctccgggcgccggtggggcacccagtacaacctgacgatcggcagcctgcagcccgaggacatcgccacctactactgccaggtctacgagttcttcgggcccggcacccgcctcgacctgaagcggaccgtggccgccccgtccgtgttcatcttcccgcccagcgac

SEQ ID NO: 11742 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcacgtgccagaccaacaaggggtacctcaactggtaccagcagaagcgcggccgggcccccaagctgctgatgtacgacgggtccaagctcgtgaccggcgtgcccagccgcctgtccgggcggcgctggggcacccagtacaacctgaccatcggcagcctccagcccgaggacatcgcgacctactactgccaggtctacgagttcttcgggcccggcacccggctggacctgaagcgcacggtggccgccccgtccgtgttcatcttcccgcccagcgac

SEQ ID NO: 11743 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcacgtgccagaccaacaaggggtacctcaactggtaccagcagcgccggggccgcgcccccaagctgctgatgtacgacgggtccaagctcgtgaccggcgtgcccagccggctgtccgggcgccggtggggcacccagtacaacctgaccatcggcagcctccagcccgaggacatcgcgacctactactgccaggtctacgagttcttcgggcccggcacccgcctggacctgaagcggacggtggccgccccgtccgtgttcatcttcccgcccagcgac

SEQ ID NO: 11744 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcacgtgccacaccaacaaggggtacctcaactggtaccagcagcgccggggccgcgcccccaagctgctgatgttcgacgggtccaagctcgtgaccggcgtgcccagccggttctccgggcgccggtggggcacccagtacaacctgaccatcggcagcctgcagcccgaggacatcgcgacctactactgccaggtctacgaggtgttcgggcccggcacccgcctcgacctgaagcggacggtggccgccccgtccgtcttcatcttcccgcccagcgac

SEQ ID NO: 11745 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcaactgccagaccaacaaggggtacctcaactggtaccagcagcgccggggccgcgcccccaagctgctgatgtacgacgggtccaagctcgtgaccggcgtgcccagccggttctccgggcgccggtggggcacccagtacaacctgacgatcggcagcctgcagcccgaggacatcgcgacctactactgccaggtctacgagttcttcgggcccggcacccgcctcgacctgaagcggaccgtggccgccccgtccgtgttcatcttcccgcccagcgac

SEQ ID NO: 11746 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgcccgcgtgggcgacaaggtcaccatcacgtaccagaccagcgccgggtacctcaactggtaccagcagcggcgcggccgggcgcccaagctgctgatgtacgacgggtcccgcctcgtgaccggcgcccccagccggttctccgggcgccggtggggcacccagtacaacctgacgatcggcagcctgcagcccgaggacatcgccacctactactgccaggtgtacgagttcttcgggcccggcacccgcctcgacctgaagcggaccgtcgccgccccgtccgtgttcatcttcccgcccagcgac

SEQ ID NO: 11747 - RNA, 345 nt, synthetic construct
  misc_feature 1..345: note = derived and/or modified sequence opt1 from anti-HIV_Chain
  source 1..345: mol_type = other RNA
gacatccagatgacccagagcccctccagcctgtccgccagcgtgggcgacaccgtcacgatcacgtgccagaccaacaaggggtacctcaactggtaccagcagcgccggggccgcgcccccaagctgctgatgtacgacgggtccaagctcgtgaccggcgtgcccagccggttctccgggcgccggtggggcacccagtacaacctgaccatcggcagcctgcagcccgaggacatcgcgacctactactgccaggtctacgagttcttcgggcccggcacccgcctcgacctgaagcggacggtggccgccccgtccgtgttcatcttcccgcccagcgac

SEQ ID NO: 11748 - RNA, 345 nt, synthetic construct
  misc_feature 1..345: note = derived and/or modified sequence opt1 from anti-HIV_Chain
  source 1..345: mol_type = other RNA
gtgaccctgagcctctcccccggcgagcgcgccaccctgagctgccgggcctcccagacgatcagcaacaactacctggcgtggtaccagcagaagcccgggcaggcgccccgcctcctgatctacggcgcctccagcggggccaccggcctgcccgaccggttctccgggagcggctccggcaccgacttcaccctcacgatcagccgcctggagcccgaggacttcgccgtctactactgccaccagtacgccctgtccccgtggaccttcgggcggggcaccaaggtggagatcaagcgcaccgtggccgcccccagcgtcttcatcttcccgccctccgac

SEQ ID NO: 11749 - RNA, 345 nt, synthetic construct
  misc_feature 1..345: note = derived and/or modified sequence opt1 from anti-HIV_Chain
  source 1..345: mol_type = other RNA
accctgagcgcctccgtgggcgaccgcgtcaccatcacgtgccgggccagccagtccatcaacaactacctcaactggtaccagcagaagcccgggaaggcgcccaagctgctgatctacgccgccagctccctccagagcggcgtgccctcccgcttcagcgggtccggcagcgggaccgacttcaccctgaccatctccagcctgcagcccgaggacttcgtgacgtactactgccagcagacctactccaacccccggatgttcggccagggcaccaaggtcgagatcaagcgcaccgtggccgccccgagcgtgttcatcttcccgccctccgacgagcag

SEQ ID NO: 11750 - RNA, 345 nt, synthetic construct
  misc_feature 1..345: note = derived and/or modified sequence opt1 from anti-HIV_Chain
  source 1..345: mol_type = other RNA
cagagcgccctgacccaggccccctccgcgagcggcaccccggggcagcgcgtgacgatctcctgcagcggcgggggctccaacatcgggggcaacctcgtcagctggtaccagcacttccccggcgccgcccccaagctgctgatctaccggaacgaccagcgcccctccggggtgccggaccggttcagcgcctccaagagcggcacctccgccagcctcgcgatctccgggctgcgcagcgacgacgaggccacctacttctgcgccgcctacgactccaccctgagcctccggctgttcggcgggggcacgaccctggcggtgctctcccagcccaaggcc

SEQ ID NO: 11751 - RNA, 345 nt, synthetic construct
  misc_feature 1..345: note = derived and/or modified sequence opt1 from anti-HIV_Chain
  source 1..345: mol_type = other RNA
aagcccagccagaccctgtccctgacctgcacggtgagcggcgggtccatcagctccgccggctactactggacctggatccgccaccacccggggaagggcctcgagttcatcgggtacatctaccacatcggcaccccctactacaaccccagcctgaagtcccggctcaccatcagcatcgacacgtccaagaaccagttcagcctgaagctgtccagcgtcaccgccgcggacaccgccatctactactgcgcccgcgactacaccgcccggggccgccacttcttcgactactgggggcagggcgccctcgtgacggtgtccagcgcgtccaccaagggg

SEQ ID NO: 11752 - RNA, 345 nt, synthetic construct
  misc_feature 1..345: note = derived and/or modified sequence opt1 from anti-HIV_Chain
  source 1..345: mol_type = other RNA
cccagcgagaccctgtccctgacctgccgcgtgagcggcgcctccatcagcaacttctactggacgtggatccggcagcccgccgggaagggcctcgagtggatcgggcgcctgtactccagcgacaagaccaactacaacccctccctcaacggccgggtcaccatgagcctggacacctccaagaaccagttcagcctgcgcctcacgtccatgaccgacgcggacaccgccatctactactgcgcccgggagaaggggcagtgggtgaccctgccgccctactacttcgacagctggggccagggcatcctggtgacggtctccagcgcctccaccaagggg

SEQ ID NO: 11753 - RNA, 348 nt, synthetic construct
  misc_feature 1..348: note = derived and/or modified sequence opt1 from anti-HIV_Chain
  source 1..348: mol_type = other RNA
ggccccgccaccctgagcgtgtcccccggggagcgcgccaccctcagctgccgggcgtcccagagcctgcgcaacaacctggcctggtaccagcagaagacgggccagagcccccggctcctgatctacgccgtctccacccgcgccaccgggatcccgccccggttctccggcgggggcagcggcaccgagttcacgctgaccatcgactccctccagagcgaggacttcgccgtgtacttctgccagcagtacgacagcccccagtggaccttcgggcagggcaccaaggtggagatcaagcgcacggtcgcggccccctccgtgttcatcttcccgccctccgac

SEQ ID NO: 11754 - RNA, 348 nt, synthetic construct
  misc_feature 1..348: note = derived and/or modified sequence opt1 from anti-HIV_Chain
  source 1..348: mol_type = other RNA
gcccccgtgaccctgagcgcctccgtcggcgacaccgtgacgatcacgtgccgcgcgagccagccgatcgccaccttcctcaactggtaccagcacaagcccgggcaggcccccaagctgctgatctacgccgcctccaccttccagcggggcgcgcccagccgctactccgggagcggctccgggaccgacttcaccctcaccatcaacagcctgcagccggaggacctggccacctactactgccagcagacgttcaccgaccccgtgaccttcggccagggcacccggctcgagatcaagcgcacggtcgccgccccctccgtgttcatcttcccgcccagcgac

SEQ ID NO: 11755 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggggctggctcgcgtggtaccaccagcgcccggggaaggcgccccggctgctgatctaccgcggctcccggctcctcgggggcgtccccagccgcttctccggcagcgccgccgggaccgacttcaccctgacgatcgccaacctgcaggccgaggacttcggcaccttctactgccagcagtacgacacctaccccgggaccttcggccaggggacgaaggtggaggtgaagcggaccgtcgccgccccgtccgtgttc

SEQ ID NO: 11756 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggaactgggtcgcgtggtaccagcagcgcccgggcaaggcgccccggctcctgatctaccgcggggccgccctgctcggcggggtgccctcccggttcagcggctccgccgccggcaccgacttcaccctgacgatcgggaacctgcagaccgaggacttcggcaccttctactgccagcagtacgacacctaccccgggacgttcggccaggggaccaaggtggaggtcaagcgcaccgtggccgccccgagcgtgttc

SEQ ID NO: 11757 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggaactgggtcgcgtggtaccagcagcgcccgggcaaggcgccccggctcctgatctaccgcggggccgccctgctcggcggggtgccctcccggttccgcggcagcgccgccggcaccgacttcaccctgacgatcgggaacctgcaggccgaggacttcggcaccttctactgccagcagtacgacacctaccccgggaccttcggccaggggacgaaggtggaggtcaagcggaccgtggccgccccgtccgtgttc

SEQ ID NO: 11758 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccgtgggcgacacggtccgcatcagctgccgggcctcccagagcatcaccgggggctggctcgcgtggtaccaccagcgcccggggaaggcgccccggctgctgatctaccgcggctcccggctcctcgggggcgtgcccagccgcttctccggcagcgccgccgggaccgacttcaccctgacgatcgccaacctgcaggccgaggacttcggcaccttctactgccagcagtacgacacctaccccgggaccttcggccaggggacgaaggtggaggtcaagcggaccgtggccgccccgtccgtgttc

SEQ ID NO: 11759 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggaactgggtcgcgtggtaccagcagcgcccgggcaaggcgccccggctcctgatctaccgcggggccgccctgctcggcggggtgccctcccggttcagcggctccgccgccggcaccgacttcaccctgacgatcgggaacctgcaggccgaggacttcggcaccttctactgccagcagtacgacacctaccccgggaccttcggccaggggacgaaggtggaggtcaagcgcaccgtggccgccccgagcgtgttc

SEQ ID NO: 11760 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggggctgggtcgcgtggtaccaccagcgcccggggaaggcgccccggctcctgatctaccgcggctcccggctgctcgggggcgtgcccagccgcttctccggcagcgccgccgggaccgacttcaccctgacgatcggcaacctgcaggccgaggacttcgggaccttctactgccagcagtacgacacctaccccggcaccttcgggcagggcacgaaggtggaggtcaagcggaccgtggccgccccgtccgtgttc

SEQ ID NO: 11761 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccgtgggcgacacggtccgcatcagctgccgggcctcccagagcatcaccgggggctggctcgcgtggtaccaccagcgcccggggaaggcgccccggctgctgatctaccgcggctcccggctcctcgggggcgtgcccagccgcttctccggcagcgccgccgggaccggcttcaccctgacgatcgccaacctgcaggccgaggacttcgggaccttctactgccagcagtacgacacctaccccggcaccttcgggcagggcacgaaggtggaggtcaagcggaccgtggccgccccgtccgtgttc

SEQ ID NO: 11762 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccgtgggcgggacggtccgcatcagctgccgggcctcccagagcatcaccggcgggtggctcgcgtggtaccaccagcgcccgggcaaggcgccccggctgctgatctaccgcgggtcccggctcctgggcggcgtgcccagccgcttctccgggagcgccgccggcaccgacttcaccctgacgatcgccaacctccaggccgaggacttcgggaccttctactgccagcagtacgacacctaccccggcaccttcgggcagggcacgaaggtggaggtcaagcggaccgtggccgccccgtccgtgttc

SEQ ID NO: 11763 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggaactgggtcgcgtggtaccaccagcgcccgggcaaggcgccccggctcctgatctaccgcggggccgccctgctcggcggggtgccctcccggttcagcggctccgccgccggcaccgacttcaccctgacgatcgggaacctgcaggccgaggacttcggcaccttctactgccagcagtacgacacctaccccgggaccttcggccaggggacgaaggtggaggtcaagcgcaccgtggccgccccgagcgtgttc

SEQ ID NO: 11764 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgatgatcagctgccgcgcctcccagagcatcaccgggggctggctcgcgtggtaccaccagcggccggggaaggcgccccgcctgctgatctaccggggctccaagctcctcgggggcgtccccagccgcttctccggcagcgccgccgggaccggcttcaccctgacgatcgggaacctgcaggccgaggacttcggcaccttctactgccagcagtacgacacctaccccgggaccttcggccagggcacgaaggtggaggtgaagcggaccgtcgccgccccgtccgtgttc

SEQ ID NO: 11765 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccgtgggcgacacggtccgcatcagctgccgggcctcccagagcatcaccgggggctggctcgcgtggtaccaccagcgcccggggaaggcgccccggctgctgatctaccgcggctcccggctcctcgggggcgtgcccagccgcttctccggcagcgccgccggggccgacttcaccctgaccatcgccaacctgcaggccgaggacttcggcacgttctactgccagcagtacgacacctaccccgggaccttcggccaggggaccaaggtggaggtcaagcggacggtggccgccccgtccgtgttc

SEQ ID NO: 11766 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggggctggctcgcgtggtaccaccagcgcccggggaaggcgccccggctgctgatctaccgcggctcccggctcgtcgggggcgtgcccagccgcttctccggcagcgccgccgggaccgacttcaccctgacgatcggcaacctgcaggccgaggacttcgggaccttctactgccagcagtacgacacctaccccggcaccttcgggcagggcacgaaggtggaggtcaagcggaccgtggccgccccgtccgtgttc

SEQ ID NO: 11767 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggggctggctcgcgtggtaccaccagcgcccggggaaggcgccccggctgctgatctaccgcggctcccggctcctcgggggcgtccccagcaagttctccggcagcgccgccgggaccgacttcaccctgacgatcgccaacctgcaggccgaggacttcggcaccttctactgccagcagtacgacacctaccccgggaccttcggccaggggacgaaggtggaggtgaagcgcaccgtcgccgccccgtccgtgttc

SEQ ID NO: 11768 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccacgggcgacaccgtgcgcatcagctgccgggcctcccagagcatcaccgggaactgggtcgcgtggtaccagcagcgcccgggcaaggcgccccggctcctgatctaccgcggggccgccctgctcggcggggtgccctcccggttccgcggcagcgccgccggcaccgacttcacgctgaccatcgggaacctgcaggccgaggacttcggcaccttctactgccagcagtacgacacctaccccgggacgttcggccaggggaccaaggtggaggtcaagcggaccgtggccgccccgtccgtgttc

SEQ ID NO: 11769 - RNA, 351 nt, synthetic construct
  misc_feature 1..351: note = derived and/or modified sequence opt1 from anti-HIV_LightChain
  source 1..351: mol_type = other RNA
gacatccagatgacccagagcccctccaccctgagcgcctccatcggcgacacggtgcgcatcagctgccgggcctcccagagcatcaccgggaactggctcgcgtggtaccaccagcgcccgggcaaggcgccccggctgctgatctaccgcgggtcccggctcctgggcggggtccccagccgcttctccggcagcgccgccggcaccgacttcaccctgacgatcgccaacctccaggccgaggacttcgggaccttctactgccagcagtacgacacctaccccggcaccttcgggcagggcacgaaggtggaggtgaagcggaccgtcgccgccccgtccgtgttc

SEQ ID NO: 11770 - RNA, 351 nt, synthetic construct
  misc_feature 1..351: note = derived and/or modified sequence opt1 from anti-HIV_Chain
  source 1..351: mol_type = other RNA
atcatcctgttcctcgtggccaccgccaccggcagctgggcgcagtccgccctgacgcagccccgcagcgtctccgggagcctgggccagtccgtgaccatcagctgcaccgggtccagctccgacgtgggccggtacaactacgtcagctggtaccagcaccacccggggaaggcccccaagctcatgatctccgacgtgaacaagcgccccagcggcgtgcccgaccggttctccggcagcaagtccgggaacaccgccagcctgacgatctccggcctgcaggccgaggacgagaccgactactactgctgcagctacgcggggtcctacatctgggtcttcggcggg

SEQ ID NO: 11771 - RNA, 351 nt, synthetic construct
  misc_feature 1..351: note = derived and/or modified sequence opt1 from anti-HIV_Chain
  source 1..351: mol_type = other RNA
cccgtgaccctgagcgcctccgtcggcgaccgcgtgaccatcacgtgccgggccagcgaggacatctccaagtacctcaactggtaccagcacaagcccgggaaggcgcccaagctgctgatctacaccgccagctccctcgagaccggcgtgcccagccgcttctccgggagcggctccgggaccgacttcagcctgacgatctccagcctgcagcccgacgacttcgccacctactactgccagcagtcctacaccagctccgtcaccttcggccagggcacgcgggtggaggtgaagcgcaccgtcgccgccccgagcgtgttcatcttcccgccctccgacgagcag

SEQ ID NO: 11772 - RNA, 351 nt, synthetic construct
  misc_feature 1..351: note = derived and/or modified sequence opt1 from anti-HIV_Chain
  source 1..351: mol_type = other RNA
gtggaggagcccggcagctccgtcaaggtgagctgcaaggcctccgggggcagctccaccgcctacgggtacagctgggtgcgccaggcgccgggccaggggttcgagtggatgggccggatcatccccttctacggcatcatcacctacgcccccaagttccaggggcgcgtcacgatcaccgccgaccggtccaccagcaccgtgtacatggagctgacgcgcctcaccttcgccgacaccgccctgttcttctgcgcgcgggactacggcgacccccgcaacgggtactacttcgactcctgggaccagggcctgtggctcaccgtgagctccgccagcacgaagggg

SEQ ID NO: 11773 - RNA, 351 nt, synthetic construct
  misc_feature 1..351: note = derived and/or modified sequence opt1 from anti-HIV_Chain
  source 1..351: mol_type = other RNA
caggtgcgcctggagcagagcggcgccgccgtccggacccccggggcgtccgtgaccctcagctgccaggcctccggctacaagttcgtgaactacatcatccactgggtccgccagcggccggggctggccttcgagtgggtgggcatgatcgacccctaccgcgggcggccctggagcgcccactccttcgagggccgcctgagcctctcccgggacgtgagcatggagatcctgtacatgacgctgacctccctccgcagcgacgacaccgccacctacttctgcgcgcgggccgaggccgagtcccagagccactcccgccccatcatcagcacgtccggcgcccgg

SEQ ID NO: 11774 - RNA, 351 nt, synthetic construct
  misc_feature 1..351: note = derived and/or modified sequence opt1 from anti-HIV_Chain
  source 1..351: mol_type = other RNA
gtgcacctggaggtccagctccagcagagcggccccgagctgaagaagccgggggagaccgtgaagatctcctgcaaggccagcgtgtacaccttcacggagtaccccatccactgggtcaagcaggcccccggcaaggggttcaagtggatgggctggatcaacacctactccggggagcccacctacgcggacgacttcaagggccgcttcgccttcagcctggagacctccgccagcacggcctacctccagatcaactccctgaagaacgaggacaccgccacctacttctgcgcgagcctgggccgggactactgggggcagggccaggggaccacgctcaccgtg

SEQ ID NO: 11775 - RNA, 354 nt, synthetic construct
  misc_feature 1..354: note = derived and/or modified sequence opt1 from anti-HIV_Chain
  source 1..354: mol_type = other RNA
ctgagcgtgtccctcggcgagcgcgccaccatcaactgcaagagctcccagagcatcctgtactccagcgacaagaagaactacctggcctggtaccagcagaagatcgggcagcccccgaagctcctgctgtactgggcgtccacccgggagagcggcatccccgaccgcttctccgggagcggctccgggagcgacttcacgctcaccatctccagcctgcagcccgaggacgtcgccgtgtactactgccagcagtactacatctcccccttcaccttcggccccggcaccaaggtggacctgaagcggacggtcgccgcccccagcgtgttcatcttcccgccctccgac

SEQ ID NO: 11776 - RNA, 354 nt, synthetic construct
  misc_feature 1..354: note = derived and/or modified sequence opt1 from anti-HIV_Chain
  source 1..354: mol_type = other RNA
cagagcgtgctgacccagcccccgtccgccagcggcgcccccgggcagcgcgtcaccatctcctgcagcggcgggccctccaacgtgggcgggaactacgtgtactggtaccggcagttccccggcacggcgccgaagctcctgatcctgcgcgacgaccagcggcccagcggcgtccccgaccgcttctccgccagcaagtccgggaacagcgcctccctcgccatcagcggcctgcggcccgacgacgaggccttctacttctgcgcgacctacgactccgacgggagcatccgcctgttcggcgggggcaccgccctcaccgtgctgtcccagccgaaggccgcccccagc

SEQ ID NO: 11777 - RNA, 354 nt, synthetic construct
  misc_feature 1..354: note = derived and/or modified sequence opt1 from anti-HIV_Chain
  source 1..354: mol_type = other RNA
aaggcccccgccaccctgagcctctcccccggcgagcgcgcgaccctgagctgccgggcctcccagagcgtggggtccgacctggcctggtaccagcagaagcccggccaggcgccccgcctcctgatctacgacgccagcaaccgggccacggccatccccgcccgcttctccgggagcggctccgggaccgacttcaccctgagcatctccagcctcgagccggaggacttcgccgtctacttctgccagcagcggtacgacaagatcaccttcggccagggcacgcgcctggagatccagcggaccgtggcggccccctccgtgttcatcttcccgcccagcgacgagcag

SEQ ID NO: 11778 - RNA, 354 nt, synthetic construct
  misc_feature 1..354: note = derived and/or modified sequence opt1 from anti-HIV_Chain
  source 1..354: mol_type = other RNA
caggtgcagctggtccagagcggcgccgaggccaagcgccccggggactccgtgaaggtgagctgcaaggcgtccggctacaccttcaccgagtactacatccactgggtccggcagacgccggggcagggcttcgagtggatggggatcatcacccccggcgccggcaacaccacctacgcccagaagttccaggggcgcatcacggtgacccgggacaccagcgccgccaccgtgtacatggagctctccaacctgacgagcgaggacaccgcggtctacttctgctcccgcggcgtgagcttctgggggcagggcaccctggtgaccgtctccagcgcctccacgaagggg

SEQ ID NO: 11779 - RNA, 354 nt, synthetic construct
  misc_feature 1..354: note = derived and/or modified sequence opt1 from anti-HIV_HeavyChain
  source 1..354: mol_type = other RNA
gaggtgaagctgcagcagagcggcgccgagctcgtccgccccggggcctccgtgaagatgagctgcaaggcgtccggctaccggttcaccagctacaacatgcactgggtgaagcagaccccgcgccaggggctggagtggatcggcgccatctaccccgggaacggcgacacgtcctacaaccagaagttcaagggcaaggccaccctgaccgtcgacaagagctccagcaccgcctacatgcagctctccagcctgacgtccgaggacagcgccgtgtacttctgcgcgcgggggcgcctgtccctcggcttcgactactgggggcagggcagcaccctgaccgtgtccagc

SEQ ID NO: 11780 - RNA, 357 nt, synthetic construct
  misc_feature 1..357: note = derived and/or modified sequence opt1 from anti-HIV_Chain
  source 1..357: mol_type = other RNA
caggtgcagctggtccagagcggcaccgccgtgaagcgccccggggcctccgtgcgggtcagctgccaggcgtccggctacaccttcatcgaccacttcatctactggtggcgccaggccccggggcagggcctcgagtggctggggtggatcaaccccctgacgagccagccctcctaccccagccggttccagggccgcctcaccctgacccgggacaccttcgacgagatgctgtacatggacctccgcggcctgcggtccgacgacacggggatctacttctgcgcccgccggcacagcgactactgcgacttcgacatctggggctccgggacccagatcatcgtgagctcc

SEQ ID NO: 11781 - RNA, 357 nt, synthetic construct
  misc_feature 1..357: note = derived and/or modified sequence opt1 from anti-HIV_Chain
  source 1..357: mol_type = other RNA
caggtgcagctggtccagagcggcaccgccgtgaagcgccccggggcctccgtgcgggtcagctgccaggcgtccggctacaccttcacggactacttcatctactggtggcgccaggccccggggcagggcctcgagtggctggggtggatcaaccccctgaccagccagccctcctaccccagccggttccagggccgcctcaccctgacccgggacacgttcgacgagatgctgtacatggacctccgcggcctgcggtccgacgacaccgggatctacttctgcgcccgccggcacagcgactactgcgacttcgacatctggggctccgggacccagatcatcgtgagctcc

SEQ ID NO: 11782 - RNA, 357 nt, synthetic construct
  misc_feature 1..357: note = derived and/or modified sequence opt1 from anti-HIV_Chain
  source 1..357: mol_type = other RNA
cagagcgtgctgacccagccccgctccgtcagcggctccccggggcagagcgtgaccatctcctgcacgggcaccagctccgacgtcgggggctacaactacgtgagctggtaccagcagcaccccgggaaggcccccaagaccatgatcttcgacgtgaccaagcggccctccggcgtgccggaccgcttcagcggctccaagagcgggaacacggcctccctcaccatcagcggcctgcaggcggaggacgaggccgactactactgctccagctacgccgggcggaacaccttctacgtcttcggcaccgggacgaccgtgaccgtgcaggtctcccccagccagcccccgccc

SEQ ID NO: 11783 - RNA, 357 nt, synthetic construct
  misc_feature 1..357: note = derived and/or modified sequence opt1 from anti-HIV_Chain
  source 1..357: mol_type = other RNA
gagatcgtgctgacccagagccccggcaccctctccctgagcccgggggagcgcgccacgctgtcctgccgggccagccagtccgtcagctccaactacctcgcgtggtaccagcagaagcccggccaggcgccccgcctgctgatctacggggccagctcccgggccaccggcatccccgaccgcttcagcgggtccggcagcggcaccgacttcaccctctccatcagccggctggagccggaggacttcgccgtgtactactgccagcagtacgggacgtccagctgcaccttcggccaggggaccaagctggagatcaagcgcaccgtggccgccccctccgtcttcatcttc

SEQ ID NO: 11784 - RNA, 357 nt, synthetic construct
  misc_feature 1..357: note = derived and/or modified sequence opt1 from anti-HIV_Chain
  source 1..357: mol_type = other RNA
ctgagcgcctccgtgggcgaccgcgtcaccatcacgtgccgggccagccagtccatcgaccgctacctcaactggtaccagcagaagcccgggaaggcgcccaagctgctgatctacgccgccagctccctccacaccgacgtgcccagccggttctccggcagcggggccggcacctacttcaccctgaccatcacgtccctgcagcccgaggacttcgccacctactactgccagcagagccactcccccagcttcgggcaggagtcctacagcatcaccttcggccagggcacccgcctcgagatcaagcggacggtggcggccccgtccgtcttcatcttcccgcccagcgac

SEQ ID NO: 11785 - RNA, 357 nt, synthetic construct
  misc_feature 1..357: note = derived and/or modified sequence opt1 from anti-HIV_Chain
  source 1..357: mol_type = other RNA
aacttcatgctgacccaggcccccagcgcctccggcgcgccggggcagcgcgtgaccatcagctgctccggcgggcccagcaacgtcggcgggaactacgtgtactggtaccggcagtaccccggcacggcccccaagctcctgatcctgcgcgacgaccagcggccgtccggcgtgcccgaccgcttcagcgcctccaagagcgggaactccgccagcctcgccatctccgagctgcggcccgacgacgaggcgttctacttctgcgccacctacgacagcgacggctccatccgcctgttcgggggcgggaccgccctcaccgtcctgagccagcccaaggccgcgccgtccgtg

SEQ ID NO: 11786 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgccagcatcggcgaccgcgtgaacatcacgtgccaggcctcccgggacaccgggagcgcgctcaactggtaccagcagaaggtcggccgcccgccccggctgctgatctccgccgtgagcaacctcggggccggcgtgccctcccgcttcagcgggcggcgctccggcacccagagcaccctgaccatcaacacgctgcagcccgaggacatcgccacctacttctgccagcactacgagttcttcggccccgggaccaaggtcgacatcaagcggaccgtggccgcgccctccgtgttcatcttcccgcccagcgacgagcag

SEQ ID NO: 11787 - RNA, 360 nt, synthetic construct
  misc_feature 1..360: note = derived and/or modified sequence opt1 from anti-HIV_Chain
  source 1..360: mol_type = other RNA
cagagcgtgctgacccagcccgcctccgtcagcggctccccggggcagagcatcaccatctcctgcacgggcaccagcaacgacgtcgggggccagaacttcgtgtcctggtaccagcagcaccccgggaccgcgccccagctcctgatctacgacgtgaccaaccgccccgccggcgtgagctcccggttcagcggctccaagagcgggaacacggcctccctgaccatcagcggcctccgcaccgaggacgaggccgactactactgcgcctccttcaccatcctgaacggggtggactacgtcttcggcacggggaccaaggtgaccgtgctgctcagcccgtcccagccctacctg

SEQ ID NO: 11788 - RNA, 360 nt, synthetic construct
  misc_feature 1..360: note = derived and/or modified sequence opt1 from anti-HIV_Chain
  source 1..360: mol_type = other RNA
aacttcatgctgacccagcccgccagcgtgtccggcagcccggggcagtccatcaccctcagctgcacgggcaccacctccgacgtccgcgacagcaacttcgtgtcctggtaccagcaggtccccgggaaggcccccaagctgatcatctacgacgtgagcgcgcggccctccggcgtgagcttccgcttctccgggagcaagtccggcaacaccgccagcctgacgatctccggcctccaggccgaggacgaggccctgtactactgcagctccttcaccccgaccaacaccctggtgttcgggggcgggacgaagctcaccgtcctgggccagcccaaggccgcgcccagcgtgacc

SEQ ID NO: 11789 - RNA, 360 nt, synthetic construct
  misc_feature 1..360: note = derived and/or modified sequence opt1 from anti-HIV_Chain
  source 1..360: mol_type = other RNA
cagagcgccctgacccagcccccggccgcgtccggcgcccccgggcagcgcgtgaccatcagctgctccggcgggggcagcaacgtcgggggcaacctcgtgtcctggtaccagcagttccccggcgccgcccccaagctgatcctgcaccgggacgggcagcgcccgagcggcgtgcccgaccggttctccgccagcaagtccgggacgagcgcgtccctcaccatcagcggcctgcgctccgacgacgaggccacctacttctgcgccgcctacgacagcgcggtctccctgcccgtgttcgggggcggcaccaagctcacggtgctgagccagcccaaggccgccccgctggtcacc

SEQ ID NO: 11790 - RNA, 360 nt, synthetic construct
  misc_feature 1..360: note = derived and/or modified sequence opt1 from anti-HIV_Chain
  source 1..360: mol_type = other RNA
cagctggtgctcacccagcccccgagcgtctccggcacccccgggcagaacgtgacgatcagctgctccggcgggggcagccacgtcgggggcaacctggtgtcctggtaccagcacttccccggcgccgcccccaagctgctcatccaccgcgacaaccagcggccgagcggggtgcccgaccgcttctccgcgctcaagagcggcaactccgccagcctggccatctccgggctgcggagcgacgacgaggccttctacttctgcgccgtgtacgactccagcctgtccctgggcctcttcgggggcggcaccaagctgaccgtcctgagccagcccaaggcggccccctccgtgacc

SEQ ID NO: 11791 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgccagcgtgggcgaccgcgtctccatccactgccaggccgggcagggcatcgggagctccctcaagtggtaccagcagaagtccggccgggcgccccgcctgctggtgcacggggccagcaacctccagcggggcgtgcccagccgcttctccggcagcgggttccacaccacgttcaccctgaccatctccagcctgcagcccgacgacgtcgccacctactggtgcgccgtgctcgagttcttcggccccgggacgaaggtggagatcaagcggaccgtcgccgcgccgtccgtgttcatcttcccgcccagcgacgagcag

SEQ ID NO: 11792 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgccagcgtgggcgaccgcgtcaccatcacgtgccaggcctcccaggggatcggcagctccctccagtggtaccagcagaagcccgggcgggcgcccaagctgctggtgcacggcgccagcaacctccaccgcggggtgccctcccggttcagcggctccggcttccacaccagcttcaccctgaccatctccagcctgcagcccgacgacgtcgccacgtacttctgcgccgtgctcgagttcttcgggccgggcaccaaggtggagatcaagcgcaccgtcgccgcgccctccgtgttcatcttcccgcccagcgacgagcag

SEQ ID NO: 11793 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgccagcgtgggcgaccgcgtctccatcaactgccaggccgggcagggcatcgggagctccctcaactggtaccagcagaagcggggcaaggcgcccaagctgctggtgcacggggccagcaccctccagcgcggcgtgccctcccggttcagcggctccgggttccacacgaccttcaccctgaccatcagctccctgcagcccgacgacgtcgccacgtacttctgcgagagcttccagtggttcggccccgggaccaaggtggagatcaagcgcaccgtggccgccccgtccgtcttcatcttcccgcccagcgacgagcag

SEQ ID NO: 11794 - RNA, 360 nt, synthetic construct
  misc_feature 1..360: note = derived and/or modified sequence opt1 from anti-HIV_Chain
  source 1..360: mol_type = other RNA
tacatccagatgacccagagcccctccagcctgtccgccagcatcggcgaccgcgtgaccatcacgtgccaggccgggcagggcatcgggtccagcctcaactggtaccagcagaagcccggcaaggcgcccaagctgctggtccacggggcctccaacctccagcggggcgtgagctcccgcttcagcggctccgggttccacaccaccttcaccctgacgatcagctccctgcggcccgaggacgtgggcacctacttctgcgaggtctacgagttcatcgggcccggcaccaaggtggacatcaagcgcaccgtggccgccccgagcgtcttcatcttcccgccctccgacgagcag

SEQ ID NO: 11795 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgccggcctccgtgggcgacaccgtcacgatcacgtgccaggccgggcagggcatcgggagctccctccagtggtaccagcagcgccccggccgggcgcccaacctgctggtgtacgacgccagcaacctccagcgcggggtgccctcccggttcaccggcaccggcttccacaccaccttcaccctgaccatccgcgggctgcggccggaggacttcggcacgtacttctgcgccagcctcgagttcttcgggcccggcaccaaggtcgacatcaagcgcaccgtggccgccccctccgtgttcatcttcccgcccagcgacgagcag

SEQ ID NO: 11796 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgccagcgtgggcgaccgcgtcaccatcacgtgccaggcctcccaggggatcggcagctccctccagtggtaccagcagaagcccgggcgggcgcccaacctgctggtgcacggcgccagcaacctccaccgcggggtgccctcccggttcagcggctccggcttccacaccaccttcagcctgaccatctccgggctgcagcgcgacgacttcgccacgtacttctgcgccgtcctcgagttcttcggccccgggaccaaggtggacatcaagcggaccgtggccgcgccgagcgtcttcatcttcccgccctccgacgagcag

SEQ ID NO: 11797 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgtgagcgtcggcgaccgcgtgtccatcacgtgccgggccacccaggggatcggcaacagcctcaactggtaccagcagaagcccgggaaggcccccaaggtgctgatctacggcaccaccaagctgcacgggggcgtcccctcccgcttcagcggcgggggctccgggagcaccggcacgctcaccatcgactccctgcagcccgaggacatcgcgacctacttctgccagctgttcgagttcttcgggccgggcaccaaggtggagatcaagcggacggtggccgcccccagcgtcttcatcttcccgccctccgacgagcag

SEQ ID NO: 11798 - RNA, 360 nt, synthetic construct
  misc_feature 1..360: note = derived and/or modified sequence opt1 from anti-HIV_Chain
  source 1..360: mol_type = other RNA
gacatccagatgacccagagcccctccagcctgtccgccagcgtgggcgaccgcgtcaccatcacgtgccaggccgggcagggcatcgggtccagcctcaactggtaccagcagaagcccggccgggcgcccaagctgctggtgtacggggcctccaacctccagcgcggcgtgcccagccggttctccggcagcgggttccacaccaccttcaccctgacgatctccagcctgcagcccgaggacttcgccacctacttctgctccgtctacgagttcctcggcccggggaccaaggtggagatcaagcgcaccgtggccgcccccagcgtcttcatcttcccgccctccgacgagcag

SEQ ID NO: 11799 - RNA, 360 nt, synthetic construct
  misc_feature 1..360: note = derived and/or modified sequence opt1 from anti-HIV_Chain
  source 1..360: mol_type = other RNA
cccatgttccagccgggccagagcgggggcgtggtcgtgcagtccggggagagcctgcacctctcctgcgaggccagcggcttcaagttcgcctcccagatgatgcactgggtgcgccacgtccccgggcggggcctggagtgggtggcgctgatcagctgggacggctccgggaagctgttcgccgacagcgtgcgcggccggttcaccatccaccgctggaacgaccggaactccctctacctggacgtcaagaacgtgcgccccgaggacgccgccatctactactgcacccggaacgggttcgacgtgtggggccaggggatcctcgtcacggtgagctccgccagcaccaagggc

SEQ ID NO: 11800 - RNA, 363 nt, synthetic construct
  misc_feature 1..363: note = derived and/or modified sequence opt1 from anti-HIV_HeavyChain
  source 1..363: mol_type = other RNA
gaggtgaagctggtcgagagcggcgggggcctcgtgcagcccgggggctccctgcgcctgagctgcgccgcctccgggttcaccttcagctccttcggcatgcactgggtgcggcaggcgccggagaagggcctcgagtgggtcgcctacatcagctccgggagctccaccctgcactacgccgacacggtgaagggccgcttcaccatcagccgggacaactccaagaacagcctgtacctccagatgaacctgctgcgcgccgaggacaccgccgtgtactactgcgcgcgggggtcccgcaacctcagccaccggctgctgtcctactggggccaggggaccctcgtcacggtgagctcc

SEQ ID NO: 11801 - RNA, 363 nt, synthetic construct
  misc_feature 1..363: note = derived and/or modified sequence opt1 from anti-HIV_HeavyChain
  source 1..363: mol_type = other RNA
gaggtgcagctggtcgagagcggcgggggcctcgtgcagcccgggggctccctgcgcctgagctgcgccgcctccgggttcaccttcagctccttcggcatgcactgggtgcggcaggcgccgggcaaggggctcgagtgggtcagctacatctccagcggctccagcaccctgcactacgccgacacggtgaaggggcgcttcaccatctcccgggacaacagcaagaactccctgtacctccagatgaacagcctgcgcgccgaggacaccgccgtgtactactgcgcccggggctcccgcaacctgagccaccggctcctgtcctactgggggcagggcaccctggtcacggtgagctcc

SEQ ID NO: 11802 - RNA, 363 nt, synthetic construct
  misc_feature 1..363: note = derived and/or modified sequence opt1 from anti-HIV_Chain
  source 1..363: mol_type = other RNA
gacatccagatgacccagagcccctccagcctgtccgccagcgtgggcgaccgcgtcaccatcacgtgccaggcctcccaggggatcagcaactccctcaactggtaccagcagaagcccggcaaggcgccccggctgctgatctacgggaccagcaccctccagcgcggcgtgccctcccggttcagcgggtccggcagcggcacccgcttcacggtgaccatcaactccctgcagcccgaggacatcgccacctacttctgccagcacaacgagttcttcgggcggggcaccaaggtcgacatcaagcgcacggtggccgccccgagcgtgttcatcttcccgccctccgacgagcagctg

SEQ ID NO: 11803 - RNA, 363 nt, synthetic construct
  misc_feature 1..363: note = derived and/or modified sequence opt1 from anti-HIV_Chain
  source 1..363: mol_type = other RNA
gacatccagatgacccagagcccctccagcgtgtccgccagcgtcggcgaccgcgtgaccatcacgtgccaggcctcccgggacaccgacaacagcctgacctggtaccagcagaagccggggcgcccgcccaagctcctgatctaccacgtggtcaacctgggccccggggtgccctcccggttcagcggctccgcgagctccgccacccagagcacgctcatcatctccgacttccagcccgacgacgtggccacctacttctgccagaactacgagttcttcgggcccggcaccaaggtcgagatcaagcgcaccgtggccgcccccagcgtgttcatcttcccgccctccgacgagcag

SEQ ID NO: 11804 - RNA, 363 nt, synthetic construct
  misc_feature 1..363: note = derived and/or modified sequence opt1 from anti-HIV_Chain
  source 1..363: mol_type = other RNA
gagatcgtgctgacccagagccccggcaccctctccctgagccccggggagcgcgccacgctgtcctgccgggccagccagtccgtcagctccaacaacctcgcgtggtaccagcagaagcccggccaggcgccccgcctgctgatgagcggggcctccagccgggccaccggcatccccgaccgcttctccgggagcggctccggcaccgacttcaccctcacgatcagccggctggagccggaggacttcgccgtgtaccactgccagcagtacgggtccagcccgcccaccttcggccaggggaccaaggtggagatcaagcgcaccgtcgccgccccctccgtgttcatcttcccgccc

SEQ ID NO: 11805 - RNA, 363 nt, synthetic construct
  misc_feature 1..363: note = derived and/or modified sequence opt1 from anti-HIV_Chain
  source 1..363: mol_type = other RNA
gacatccagatgacccagagcccctccagcctgtccgcctacgtgggcgaccgcgtcaccatcacgtgccgggccagccagaacatcaacacctacctcaactggtaccagcagcgcccggggaaggcgcccaagctgctgatctacgccgcctccaccctccagagcggcgtgccctcccggttcagcgggtccggcagcgggaccgacttcacgctgaccatctccaacctggagaccgaggacttcgccgtgtactactgccagcagacctaccgcagcgtcacgttcggccagggcaccaagctcgagatcaagcggaccgtggccgcgccctccgtgttcatcttcccgcccagcgac

SEQ ID NO: 11806 - RNA, 363 nt, synthetic construct
  misc_feature 1..363: note = derived and/or modified sequence opt1 from anti-HIV_Chain
  source 1..363: mol_type = other RNA
gacatccagatgacccagagcccctccagcctgtccgccagcgtgggcgaccgcgtcaccatcacgtgccaggccgggcagggcatcgggtccagcctccagtggtaccagcagaagcccggcaaggcgcccaagctgctggtgcacggggcctccaacctccaccggggcgtgcccagccgcttctccggcagcgggttccacaccaccttctccctgaccatcagcggcctgcagcgggacgacttcgccacgtacttctgcgccgtcgtggagttcttcgggcccggcaccaaggtggacatcaagcgcaccgtcgccgcgccgtccgtgttcatcttcccgcccagcgacgagcagctc

SEQ ID NO: 11807 - RNA, 363 nt, synthetic construct
  misc_feature 1..363: note = derived and/or modified sequence opt1 from anti-HIV_Chain
  source 1..363: mol_type = other RNA
caggtgcagctggtcgagagcggcgccgagctccgcaagcccggggagtccctggagatcagctgcaaggcctccggctacagcttctccagccactggatcgggtgggcgcggcagatgccgggcaaggggctggagtggatgggcatcatctaccccggcgactccaacaccatctacagcccctccttccagggccaggtgaccatcagcgccgacaagtccatcaacacggcctacctccagtggagctccctgaaggccagcgacaccgccatgtacttctgcgcgtccaactaccacgactacttctactgggggcaggggaccctggtgaccgtcagctccgccagcacgaagggc

SEQ ID NO: 11808 - RNA, 363 nt, synthetic construct
  misc_feature 1..363: note = derived and/or modified sequence opt1 from anti-HIV_Chain
  source 1..363: mol_type = other RNA
ttcgtgcagctggtcgagagcggcgggggcgtggtgcagcccgggacctccctccgcctgagctgcaccacgtccggcttcatcttcagcgactacgggatgcactgggtccggcaggccgccggcaagggcctggagtgggtggcggtgatctggcacgacgggtccaaccgcttctacgccgacagcgtcaagggccggttcaccatctcccgcgacaacagcaagaacgccgtgtacctcgagatgaacaacctgcgggtggaggacaccgccctgtactactgcgcccgcacctccatggacatcgactactgggggcagggcacgccggtcaccgtgagctccgcgagcaccaagggg

SEQ ID NO: 11809 - RNA, 363 nt, synthetic construct
  misc_feature 1..363: note = derived and/or modified sequence opt1 from anti-HIV_Chain
  source 1..363: mol_type = other RNA
gagcccatgttccagccgggccagagcgggggcgtggtcgtgcagtccggggagagcctgcacctctcctgcgaggccagcggcttcaagttcgcctcccagatgatgcactgggtgcgccacgtccccgggcggggcctggagtgggtggcgctgatcagctgggacggctccgggaagctgttcgccgacagcgtgcgcggccggttcaccatccaccgctggaacgaccggaactccctctacctggacgtcaagaacgtgcgccccgaggacgccgccatctactactgcacccggaacgggttcgacgtgtggggccaggggatcctcgtcacggtgagctccgccagcaccaagggc

SEQ ID NO: 11810 - RNA, 366 nt, synthetic construct
  misc_feature 1..366: note = derived and/or modified sequence opt1 from anti-HIV_Chain
  source 1..366: mol_type = other RNA
agccagcacctggtgcagtccggcacccaggtcaagaagcccggggccagcgtgcgcatctcctgccaggccagcggctactccttcaccgactacgtgctccactggtggcggcaggcgccggggcagggcctggagtggatggggtggatcaagcccgtctacggcgcccgcaactacgcccggcgcttccagggccggatcaacttcgaccgcgacatctaccgggagatcgccttcatggacctgagcgggctccgctccgacgacacggccctgtacttctgcgcgcgggacggcagcggggacgacacctcctggcacctggacccctggggccaggggaccctcgtgatcgtgagcgcc

SEQ ID NO: 11811 - RNA, 366 nt, synthetic construct
  misc_feature 1..366: note = derived and/or modified sequence opt1 from anti-HIV_Chain
  source 1..366: mol_type = other RNA
gacatccagatgacccagagcccctccagcctgtccgccagcgtgggcgaccgcgtcaccatcacgtgccgggcctcccagagcatctcccgctacctcaactggtaccagcagaagcccgggaaggcgcccaagctgctgatctacgccgccagctccctccagggcggggtgcccagccggttctccggcagcgggtccggcaccgacttcaccctgaccatcagctccctgcagcccgaggacttcgccacgtactactgccagcagagctccagcaagccgttcaccttcggcgggggcaccaaggtggagatcaagcgcaccgtcgccgcgccctccgtgttcatcttcccgcccagcgac

SEQ ID NO: 11812 - RNA, 366 nt, synthetic construct
  misc_feature 1..366: note = derived and/or modified sequence opt1 from anti-HIV_Chain
  source 1..366: mol_type = other RNA
gagatcgtgctgacccagagccccggcaccctctccctgagccccggggagcgcgccacgctgtcctgccgggccagccagtccatcagctccaactacctcgcgtggtaccagcagaagcccggccaggcgccccgcctgctgatctacggggccagcacccgggccaccggcatccccgaccgcttctccgggagcggctccggcaccgacttcacgctcagcatctcccggctggagccggaggacatcgccgtctactactgccaccagtacgggagctcccagcgcttcggccaggggaccaaggtggagatcaagcggaccgtggccgcccccagcgtcttcatcttcccgccctccgac

SEQ ID NO: 11813 - RNA, 366 nt, synthetic construct
  misc_feature 1..366: note = derived and/or modified sequence opt1 from anti-HIV_Chain
  source 1..366: mol_type = other RNA
gagatcgtgatgacccagagccccgccaccctgtccgtcagcccgggcgaccgcgccacgctctcctgccgggcgagccagtccgtgagcaccaacctggcctggtaccagcagaagcccgggcaggcgccccgcctgctcatctacggcgcctccacccgggccaccgggatccccgccacgttcagcggctccgggttcgccaccgagttcaccctgaccatcagctccctgcagagcgaggacttcgccgtgtactactgccagcagtacaacaactggccgcccgccttcggccagggcacgaaggtcgagatcaagcgcaccgtggcggccccctccgtgttcatcttcccgcccagcgac

SEQ ID NO: 11814 - RNA, 366 nt, synthetic construct
  misc_feature 1..366: note = derived and/or modified sequence opt1 from anti-HIV_Chain
  source 1..366: mol_type = other RNA
gacatccagatgacccagagccccgcctccctgagcgcctccgtgggcgaccgcgtcaccatcacgtgccgggcgagccaggggatctcccactacctcgcctggtaccagcagaagcccggcaaggtgccccgcctgctgatctacgccgccagccggctccagtccggggtgaccagccgcttctccggcagcgggtccggcaccgagttcaccctgacgatcagctccctgctccccgaggacgccgcggtctacttctgccagaagtacgacaccgaccccatgaccttcggccaggggacccggctggagatcaagcgcacggtggccgccccgagcgtgttcatcttcccgccctccgac

SEQ ID NO: 11815 - RNA, 366 nt, synthetic construct
  misc_feature 1..366: note = derived and/or modified sequence opt1 from anti-HIV_Chain
  source 1..366: mol_type = other RNA
cagagcgccctgacccagcccccgtccgccagcggcgcgcccgggcagcgcgtgaccatctcctgcagcggcgggccctccaacgtcggcgggaactacgtgtactggtaccggcagttccccggcacggccccgaacctcctgatcctgcgcgacgaccagcggcccagcggcgtgcccgaccgcttctccgccagcaagtccgggaacagcgcctccctcgccatcagcggcctgcggcccgacgacgaggcgttctacttctgcgccacctacgactccgacgggagcatccgcctgttcggcgggggcaccaccctcacggtcctgtcccagccgaaggccgcccccagcgtgaccctgttc

SEQ ID NO: 11816 - RNA, 366 nt, synthetic construct
  misc_feature 1..366: note = derived and/or modified sequence opt1 from anti-HIV_Chain
  source 1..366: mol_type = other RNA
gacatccagatgacccagagcccctccagcctgtccgccagcgtgggcgaccgcgtcaccatcaactgccaggccgggcagggcatcgggtccagcctcaactggtaccagaagaagcccggccgggcgcccaagctgctggtgcacggggcctccaacctccagcgcggcgtgcccagccggttctccggcagcgggttccacacgaccttcaccctgaccatctccagcctgcagcccgacgacgtcgccacgtacttctgcgccgtgttccagtggttcggcccggggaccaaggtggacatcaagcgcaccgtcgccgcgccctccgtgttcatcttcccgcccagcgacgagcagctcaag

SEQ ID NO: 11817 - RNA, 366 nt, synthetic construct
  misc_feature 1..366: note = derived and/or modified sequence opt1 from anti-HIV_Chain
  source 1..366: mol_type = other RNA
gacatccagatgacccagagcccctccagcctgtccgccagcgtgggcgaccgcgtcaccatcacgtgccaggcctcccaggggatcggcagctccctccagtggtaccagcagaagcccgggcgggcgcccaacctgctggtgcacggcgccagcaagctccaccgcggggtgccctcccggttcagcggctccggcttccacaccaccttcagcctgaccatctccgggctgcagcgcgacgacttcgccacgtacttctgcgccgtcctcgagttcttcggccccgggaccaaggtggagatcaagcggaccgtggccgcgccgagcgtcttcatcttcccgccctccgacgagcagctgaag

SEQ ID NO: 11818 - RNA, 366 nt, synthetic construct
  misc_feature 1..366: note = derived and/or modified sequence opt1 from anti-HIV_Chain
  source 1..366: mol_type = other RNA
caggtgcacctggtccagagcggcgccgaggtgaagaagcccggggcctccgtgaaggtcagctgcaaggtgtccggctacaccctcagcgagctgtccatccactgggtgcgccaggggccgggccgggggctggagtggatggcgaacttcgaccccgaggacggcgagaccatctacgcgccccagttccagggccgcgtcacgctcaccgaggacaccagcaccgacacggcctacatgcagctgacctccctgcggagcgaggacaccgccgtgtactactgcgccaccgaccgctacacggacaccgggcggtggggccccgggaccctcgtgaccgtctccagcgcctccacgaagggc

SEQ ID NO: 11819 - RNA, 366 nt, synthetic construct
  misc_feature 1..366: note = derived and/or modified sequence opt1 from anti-HIV_Chain
  source 1..366: mol_type = other RNA
caggtgcagctggtcgagagcggcgggggcctcatccagcccgggggctccctgcgcctgagctgcgaggcctccgggttcgccgtgggcgacatcaactacatgagctgggtgcggcaggcgccgggcaaggggctcgagtgggtctccgtgctgtacagcggcgggtccagccagtacgccgactccgtgaagggccgcttcaccatcagccgggacaactcccgcaacaccctgtacctccagatggacaacctgcgggccgaggacacggccgtctactactgcgcccgcgggctgcgggtgtacttcgacctctggggccagggcatcctggtgaccgtcagctccgcgagcaccaagggg

SEQ ID NO: 11820 - RNA, 366 nt, synthetic construct
  misc_feature 1..366: note = derived and/or modified sequence opt1 from anti-HIV_Chain
  source 1..366: mol_type = other RNA
caggtgcagatggtcgccagcggcgggggcctggtgaagcccgggggctccctccgcctgagctgcgaggcctccgggttcaccttcagcgactactacatgtcctgggtgcggcaggcgccgggcaagggcctggagtggatcagctacatcacctccgggggcaacgccctctactacgccgacagcgtcaaggggcgcttcacgatctcccgggacaacgccaagaacagcctgtacctgcagatgaactccctccgcgccgaggacaccgcggtgtactactgcgcccgggacctgctgcacgcccacgacttcggccgccaggggaccctcgtgaccgtcagctccgccagcacgaagggc

SEQ ID NO: 11821 - RNA, 366 nt, synthetic construct
  misc_feature 1..366: note = derived and/or modified sequence opt1 from anti-HIV_Chain
  source 1..366: mol_type = other RNA
cagctgcagctcgtggagagcggcgggggcgtcgtgcagcccgggcgctccctgcggctgagctgcgccgcctccggcttcaccttcagcacctacacgatgcactgggtgcgccaggcgccggggaagggcctcgagtgggtcgccgtgatctcctacgacggcaccaacaagtactacgccgacagcgtgaaggggcggttcaccatctcccgcgacaacagcaagaacaccctgtacctgcagatgaactccctccggggcgaggacacggccgtctactactgcgcccgcagcccctcctactacttcgactactgggggcagggcaccctggtgaccgtgagcgcggcctccaccaagggg

SEQ ID NO: 11822 - RNA, 369 nt, synthetic construct
  misc_feature 1..369: note = derived and/or modified sequence opt1 from anti-HIV_Chain
  source 1..369: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccgggtgagcctgacgcgccaggcctcctgggacttcgacacctacagcttctacatggacctgaaggccgtgcggtccgacgacaccgcgatctacttctgcgcccgccagcggagcgacttctgggacttcgacgtctgggggtccggcacccaggtgacggtgagctcc

SEQ ID NO: 11823 - RNA, 369 nt, synthetic construct
  misc_feature 1..369: note = derived and/or modified sequence opt1 from anti-HIV_Chain
  source 1..369: mol_type = other RNA
caggtgcagctgctccagagcggcgccgtcgtgaccaagcccggggcctccgtgcgcgtcagctgcgaggcgtccggctacaagatccgggactacttcatccactggtggcgccaggccccggggcagggcctgcagtgggtggggtggatcaacccccagaccggccagcccaacatcccccggccgttccagggccgcgtgacgctgacccggcacgccagctgggacttcgacaccttctccttctacatggacctcaaggccctgcgcagcgacgacaccgccatctacttctgcgcgcggcgccggtccgactactgcgacttcgacgtctgggggagcggcacgcacgtgaccgtgtccagc

SEQ ID NO: 11824 - RNA, 369 nt, synthetic construct
  misc_feature 1..369: note = derived and/or modified sequence opt1 from anti-HIV_Chain
  source 1..369: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggggctgcgctccgacgacaccgccatctacttctgcgcgcggcagcgcagcgactactgggacttcgacgtgtggggctccgggacccaggtcacggtgagctcc

SEQ ID NO: 11825 - RNA, 369 nt, synthetic construct
  misc_feature 1..369: note = derived and/or modified sequence opt1 from anti-HIV_Chain
  source 1..369: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggctgttccagggccgcgtgagcctcacgcggcacgcctcctgggacttcgacaccttcagcttctacatggacctgaaggccgtgcgctccgacgacaccgcggtctacttctgcgcccggcagcgcagcgactactgggacttcgacgtgtgggggtccggcacccaggtgacggtcagctcc

SEQ ID NO: 11826 - RNA, 369 nt, synthetic construct
  misc_feature 1..369: note = derived and/or modified sequence opt1 from anti-HIV_Chain
  source 1..369: mol_type = other RNA
caggtgcgcctgctccagagcggcgccgccgtcaccaagcccggggcgtccgtgcgggtgagctgcgaggcctccggctacgagatccgcgactacttcatccactggtggcggcaggccccggggcagggcctgcagtgggtcgggtggatcaaccccaagaccggccagcccaacaacccccgccagttccagggccgggtgagcctgacgcgccaggcctcctgggacttcgacagctactccttctacatggacctcaaggccctgcggagcgacgacaccggggtgtacttctgcgcgcgccagcggtccgactactgggacttcgacgtctggggcagcgggacccaggtgaccgtgtccagc

SEQ ID NO: 11827 - RNA, 369 nt, synthetic construct
  misc_feature 1..369: note = derived and/or modified sequence opt1 from anti-HIV_Chain
  source 1..369: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggccctgcgctccgacgacaccgcggtgtacttctgcgcccggcagcgcagcgactactgggacttcgacgtctgggggtccggcacccaggtgacggtgagctcc

SEQ ID NO: 11828 - RNA, 369 nt, synthetic construct
  misc_feature 1..369: note = derived and/or modified sequence opt1 from anti-HIV_Chain
  source 1..369: mol_type = other RNA
gaggtgcagctggtcgagagcggcgggggcctcatccagcgcgggggctccctgcggctgagctgcgtggcctccgggttccccgtgagcgacaaccacatgtcctgggtccgccaggccccgggcaagggcctcgagtgggtgagcatcatctactccgacgggggcacctactacgcggacagcgtgaaggggcggttcaccatctcccgcgacaacagcaagaacacggtctacctgcagatgaactccctgcgggccaccgacaccgccgtgtactactgcgcccgcgaccccggcttccactacgggctcgacgtgtggggccagggcaccacggtcaccgtgagctccgccagcaccaagggg

SEQ ID NO: 11829 - RNA, 369 nt, synthetic construct
  misc_feature 1..369: note = derived and/or modified sequence opt1 from anti-HIV_Chain
  source 1..369: mol_type = other RNA
caggtgcagctgcaggagagcggccccgggctcctgcgcccgctggagaccctctccctgacctgcagcgtctccggcgggagcatccggggctacttctggtcctgggtgcgccagcccgccgggcggggcctggagtggatcggccgcatctacagctccgggacgacccggttcaaccccagcctcaagtcccgcgtgcggctgagcatcgacaccgccaagtccgaggtcagcctgaacatcacctccgtgacggcggccgacagcgcctcctacttctgcgccggcaccagccccgtgcacgggggcctcgacctgtgggggctgggcctccgcgtcaccgtgtccagcgcctccaccaagggc

SEQ ID NO: 11830 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccggcaccctctccctgagcccgggggagcgcgccacgctgtcctgccgggccagccagtccgtcagctccaacctcgcgtggtacgcccagaagcccggccaggcgccccgcctgatcatctacggggccagctcccgggccagcgccatccccgaccgcttccggggctccgggagcggcaccgacttcaccctgaccatctcccgcctcgagccggaggacttcgccgtgtactactgccagcagtacgacgacgcccccatcacgttcggccacgggacccggctggagatcaagcgcaccgtggccgcgcccagcgtcttcatcttcccgccctccgacgag

SEQ ID NO: 11831 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccggcaccctctccctgagcccgggggaccgcgccgccctgtcctgccgggcgagcgagacgctctccggcaacagcctggcctggtaccagcagaagcgcgggcagccgccccggctgctcatcttcgccgcctccagccgcgccaccggcatccccgagcggttctccgggggcggcagcgggaccgacttcaccctgacgatcacccgcctggagcccgaggacttcgcggtctacttctgccagcagtacgtggacgcccccatcaccttcggccaggggacccggctcgagatcaagcgcacggtggccgccccctccgtcttcatcttcccgcccagcgac

SEQ ID NO: 11832 - RNA, 369 nt, synthetic construct
  misc_feature 1..369: note = derived and/or modified sequence opt1 from anti-HIV_Chain
  source 1..369: mol_type = other RNA
gacatccagatgacccagagcccctccagcctgtccgccagcgtgggcgaccgcgtcaccatcacgtgccgggcctcccaggacatcaccacctacctcgcgtggctgcagcagaagcccgggaaggcccccaagagcctgatctactccgccagcaccgtgcagtccggcgtgcccagccgcttctccgggagcggctccgggacggagttcaccctcaccatcagcggcctgcagcccgaggacttcgccacctactactgccagcagtacaactactacccgatcacgttcggcctggggacccggctcgagatcaagcgcaccgtcgccgcgccctccgtgttcatcttcccgcccagcgacgag

SEQ ID NO: 11833 - RNA, 369 nt, synthetic construct
  misc_feature 1..369: note = derived and/or modified sequence opt1 from anti-HIV_Chain
  source 1..369: mol_type = other RNA
gacatccagatgacccagagcccctccagcctgtccgccagcatcggcgaccgcgtgaccatcacgtgccgggccaaccagcacatccgctccttcctcaactggtaccagcagacccccgggaaggcgcccaagctgctgatctacgccgccagcaccctccagcggggcgtcccctcccgcttcagcgggtccggcagcgggaccgacttcacgctgaccatcacctccctggagcgggaggacctcgccacctactactgccagcagacgtacaccagccccatcaccttcggccagggcacccgcctggagatcaagcggacggtggccgcgccgtccgtgttcatcttcccgcccagcgacgag

SEQ ID NO: 11834 - RNA, 369 nt, synthetic construct
  misc_feature 1..369: note = derived and/or modified sequence opt1 from anti-HIV_Chain
  source 1..369: mol_type = other RNA
agcgagatcgtgctgacccagtcccccgccaccctcagcctgtcccccggcgagagcgccacgctgtcctgccgcgcgagccagtccctcagctccagcctggcctggtaccagcagaagcccgggcaggcgccccggctgctcatctacgacacctccgaccgcgccaccggcatccccgcccggttcagcgggcgcggctccgggaccgacttcacgctgaccatcagctccctggagccggaggacttcgccgtctactactgccagcagcggagcaactgggccatcaccttcggccagggcacccgcctcgagatcaagcggacggtggccgccccctccgtgttcatcttcccgcccagcgac

SEQ ID NO: 11835 - RNA, 369 nt, synthetic construct
  misc_feature 1..369: note = derived and/or modified sequence opt1 from anti-HIV_Chain
  source 1..369: mol_type = other RNA
caggtgctgagcgtctccggcacccccgggcagcgcgtgatcatcagctgctccggcaccagctccaacgtcgggggcaacctcgtgagctggtaccagcacctcccgggggccgcgccccggctgctgatccaccgcgacgaccagcggccctccggcgtgcccgaccgcttcagcggctccaagagcgggaactccgccagcctggtgatctccggcctgcggagcgacgacgaggccgactacttctgcgccgcctacgactccacgttcagcctcccggtcttcgggggcgggacccgcctgaccgtgctgtcccagcccaaggccgcgcccagcgtgaccctctacgccccctccagcgaggag

SEQ ID NO: 11836 - RNA, 369 nt, synthetic construct
  misc_feature 1..369: note = derived and/or modified sequence opt1 from anti-HIV_Chain
  source 1..369: mol_type = other RNA
gacatccagatgacccagagcccctccagcctgtccgccagcgtgggcgaccgcgtcaccatcacgtgccaggccgggcagggcatcgggtccagcctccagtggtaccagcagaagcccggcaaggcgcccaagctgctggtgcacggggcctccaacctccaccggggcgtgcccagccgcttctccggcagcgggttccacaccaccttctccctgaccatcagcggcctgcagcgggacgacttcgccacgtacttctgcgccgtcctcgagttcttcgggcccggcaccaaggtggagatcaagcgcaccgtggccgcgccgtccgtcttcatcttcccgcccagcgacgagcagctgaagtcc

SEQ ID NO: 11837 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccgccaccctctccctgagccccggcgagcgcgccacgctgtcctgccgggcgagccaggggctcaacttcgtcgtgtggtaccagcagaagcgcggccaggcgccccggctgctgatccacgccccctccgaccgcgcccccggggtgccggaccggttcagcgcccgcggctccgggaccgacttcagcctcgtcatctccagcgtggagcccgacgacttcgccatctactactgccaggagtactccagcaccccctacaacttcggccccggcacccgggtggaccgcaagcggacggtcgccgccccgtccgtgttcatcttcccgcccagcgacgagcag

SEQ ID NO: 11838 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccaccacgctctccctgagcccgggcgagcgcgccaccctgtcctgccgggccagccagggggtcaacctcgtggtgtggtaccagcagaagcgcggccaggcgccccggctgctgatctacgggccctccgaccgcgcccccggcgtcccggaccggttcagcgcccgcgggtccggcaccgagttcagcctcgtgatctccagcgtggagcccgacgacttcgccctgtactactgccaggagtactccagcaccccctacaacttcggcacggggacccgggtcgaccgcaagcggaccgtggccgcgccctccgtgttcatcttcccgcccagcgacgagcag

SEQ ID NO: 11839 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccgccaccctctccctgagccccggcgagcgcgccacgctgtcctgccgggcgagccagggggtcaacttcgtggtgtggtaccagcagaagcgcggccaggcgccccggctcctgatctacgggccctccaaccgcgcccccggcgtcccggaccggttcagcgcccgcgggtccggcaccgagttcagcctggtgatctccagcgtggagcccgacgacttcgccctctactactgccaggagtactccagcaccccctacaacttcggccccgggacccgggtcgaccgcaagcggacggtggccgccccgtccgtgttcatcttcccgcccagcgacgagcag

SEQ ID NO: 11840 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccgccaccctctccctgagccccggcgagcgcgccacgctgtcctgccgggcgagccaggggctcaacttcgtcgtgtggtaccagcagaagcgcggccaggcgccccggctgctgatccacgggccctcccaccgcgcccccggcgtgccggaccggttcagcgcccgcgggtccggcaccgagttcagcctcgtcatctccagcgtggagcccgacgacttcgccatctactactgccaggagtactccagcaccccctacaacttcggccccgggacccgggtggaccgcaagcggacggtcgccgccccgtccgtgttcatcttcccgcccagcgacgagcag

SEQ ID NO: 11841 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccgccaccctctccctgagccccggcgagcgcgccacgctgtcctgccgggcgagccaggggctcaacttcgtcgtgtggtaccagcagaagggcgggcaggcgccccgcctgctgatccacggccccaccgaccgggcccccggggtgccggaccgcttctccgcccggggcagcggcaccgagttctccctcgtcatcagctccgtggagcccgacgacttcgccctgtactactgccaggagtacagctccaccccctacaacttcgggcccggcacgcgcgtggaccggaagcgcaccgtcgccgccccgagcgtgttcatcttcccgccctccgacgagcag

SEQ ID NO: 11842 - RNA, 369 nt, synthetic construct
  misc_feature 1..369: note = derived and/or modified sequence opt1 from anti-HIV_Chain
  source 1..369: mol_type = other RNA
gagatcgtgctgacccagagccccgccaccctctccctgagccccggcgagcgcgccacgctgtcctgccgggcgagccaggggctcaacttcgtcgtgtggtaccagcagaagcgcggccaggcgccccggctgctgatccacgccccctccgggcgcgcccccggcgtgccggaccggttcagcgcccgcgggtccggcaccgagttcagcctcgtcatctccagcgtggagcccgacgacttcgccatctactactgccaggagtactccagcaccccctacaacttcggccccgggacccgggtggaccgcaagcggacggtcgccgccccgtccgtgttcatcttcccgcccagcgacgagcag

SEQ ID NO: 11843 - RNA, 369 nt, synthetic construct
  misc_feature 1..369: note = derived and/or modified sequence opt1 from anti-HIV_Chain
  source 1..369: mol_type = other RNA
caggtgcagctggtccagagcggcgccgaggtgaagaagcccgggtccagcgtgaaggtctcctgcaagaccagcggcgggtccttcagcaactacgccttctcctgggtgcgccaggcgcccggcgaggggctcgagtggatgggccggatcatccccatcttcggcaccgccaagtacacgcagaagctgcaggggcgcgtgaccatcaccgccgacaagttcaccagcacggtctacatggagctgtccagcctccggtccgaggacaccgccatctactactgcgccagcctgcaccagggccccatcgggtacaccccctggcacccgccgccccgcgcgcccctgggccagtccgtgtgcggg

SEQ ID NO: 11844 - RNA, 369 nt, synthetic construct
  misc_feature 1..369: note = derived and/or modified sequence opt1 from anti-HIV_Chain
  source 1..369: mol_type = other RNA
caggtgcagctggtcgagagcggcgggggcctcgtgcagcccgggggctccctgcgcatcagctgctccgccaccgggttcaccttcagcacgcacgccatgcactgggtgcggcaggcgccgggcaagggcctggagtacgtctccgccatcaacagcaacgggcgctccgccttctacgccgacagcgtgaagggccgggtgaccatctcccgcgacaacagcaagaacaccctcttcctgcagatgacctccctgcgggccgaggacacggcggtctactactgcgtgaaggggcccctcctgcgctacctggacagctggggccaggggaccctcgtgaccgtctccagcgcctccaccaagggc

SEQ ID NO: 11845 - RNA, 369 nt, synthetic construct
  misc_feature 1..369: note = derived and/or modified sequence opt1 from anti-HIV_Chain
  source 1..369: mol_type = other RNA
gaggtgcagctggtcgagagcggcgggggcctcgtgcagcccgggggctccctgcgcatcagctgctccgccaccgggttcaccttcagcacgcacgccatgcactgggtgcggcaggcgccgggcaagggcctggagtacgtctccgccatcaacagcaacgggcgctccgccttctacgccgacagcgtgaagggccgggtgaccatctcccgcgacaacagcaagaacaccctcttcctgcagatgacctccctgcgggccgaggacacggcggtctactactgcgtgaaggggcccctcctgcgctacctggacagctggggccaggggaccctcgtgaccgtctccagcgcctccaccaagggc

SEQ ID NO: 11846 - RNA, 369 nt, synthetic construct
  misc_feature 1..369: note = derived and/or modified sequence opt1 from anti-HIV_Chain
  source 1..369: mol_type = other RNA
gaggagagcggccccgggctggtgaagccgtcccagaccctcagcctgacctgctccgtcagcggcgactccgtgagctccgggggctacttctggagctggatccgccagcaccccacgaaggggctggagtgcctcggctacgtgtactacaccggcaacacctactacaacccctccctgaagtccccgcccaccatcgaggtcgccatggccaacaaccaggtgagcctgaagctcgggagcgtgacggcggccgacaccgccgtctactactgcgcccggatcaagcgcttccggggcgggaactacttcgacacctggggccacgggctgctggtgaccgtgtccagcgcctccacgaagggc

SEQ ID NO: 11847 - RNA, 369 nt, synthetic construct
  misc_feature 1..369: note = derived and/or modified sequence opt1 from anti-HIV_Chain
  source 1..369: mol_type = other RNA
caggtgcagctgcaggagagcggctccgggctcgtcaagcccagcggcaccctgtccctgacctgcgccgtgagcaacgggccgatctccagcggcaactggtggtcctgggtgcgccagacgcccgagaaggggctcgagtggatcggcgaggtctaccacagcggctccaccaaccacaaccccagcctgaagtcccgggccaccatcctggtggacaagagcaagaaccagttctccctcaacctgcgcagcgtgaccgcggccgacacggccgtctactactgcgcccgggtgcgcgggtcctggaacttcgactactggggccaggggatcctggtgaccgtcagctccgccagcaccaagggc

SEQ ID NO: 11848 - RNA, 369 nt, synthetic construct
  misc_feature 1..369: note = derived and/or modified sequence opt1 from anti-HIV_HeavyChain
  source 1..369: mol_type = other RNA
gaggtgcagctgcagcagagcggcaccgtcctcgcccgccccggggcctccgtgaagatgagctgcaaggcgtccggctacaccttcacgagctactggatgcactgggtgaagcagcggccggggcagggcctggagtggatcggggccatctaccccggcaactccgacaccagctacaaccagaagttcaagggcaaggccaagctgaccgccgtcacctccgccagcacggcgtacatggagctctccagcctgaccaacgaggactccgccgtgtactactgcacccgctggccccactactacgggggcagccggtactacttcgactactgggggcagggcaccacgctgaccgtgtccagc

SEQ ID NO: 11849 - RNA, 372 nt, synthetic construct
  misc_feature 1..372: note = derived and/or modified sequence opt1 from anti-HIV_Chain
  source 1..372: mol_type = other RNA
gtggtccagctggtggagagcggcgggggcctcgtgcagcccgggggctccctgcgcctgagctgcgccgcctccgggttcgcgttccggagctactggatgtcctgggtccgccaggccccgggccggggcctcgagtgggtggccaacatcaagcaggacgggagcgagaagtactacgccgactccgtgaagggccgcttcaccatcagccgggacaacaccaagaactccctgtacctgcagatgaacagcctccgcgccgaggacacggcggtcttctactgcgcctcccgcggggaccggtacggccccatcgactactgggggcagggcaccctggtgaccgtgagctccgccagcaccaagggc

SEQ ID NO: 11850 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgagatcaagaagcccggggagtccctcaagatcagctgcaaggcctccggctacaccttcaacgactactggatcgggtgggtgcgccagatgccgggcaaggggctggagtggatgggcatcttctaccccgacgacagcgactccaactacagcccctccttccagggccgggtgaccatcagcgcggacaagtccatcacgaccgcctacctgcagtggagcaccctcaaggcctccgacagcgccatgtacttctgcgcccgcctgctgggggactccggcgcgttcgacatctgggggcagggcaccatggtcatcgtgagctccgccagcacgaagggg

SEQ ID NO: 11851 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgggggcctcgtgaagcccgggggctccctgcgcctgagctgcgccgcctccgggttcaccttcagctcctacagcatgaactgggtgcggcaggcgccgggcaagggcctcgagtgggtctccagcatctccagctccagctcctacatctactacgccgacagcgtgaaggggcgcttcaccatctcccgggacaacgccaagaacagcctgtacctgcagatgaactccctccgcgccgaggacacggccgtgtactactgcgcgcgggagggcagctactactacgggatggacgtctggggccaggggaccaccgtgaccgtgtccagcgccagcacgaagggc

SEQ ID NO: 11852 - RNA, 372 nt, synthetic construct
  misc_feature 1..372: note = derived and/or modified sequence opt1 from anti-HIV_Chain
  source 1..372: mol_type = other RNA
gagatcgtgctgacccagagccccgccaccctctccgtcagccccggcgagcgcgccacgctgtcctgccgggcggggcagagcgtgtccagcgacctggcctggtaccagcacaagcccggccaggcgccccgcctcctgatctacgacgcctccaagcgggccaccgggatccccgcccgcttcagcggctccgggagcggcaccgacttcaccctgacgatctccagcctcgagccggaggacttcgccgtgtactactgccagcaccggaccaactggccgccctccatcaccttcggccaggggacccgcctggagatcaagcggacggtcgccgcccccagcgtgttcatcttcccgccctccgac

SEQ ID NO: 11853 - RNA, 372 nt, synthetic construct
  misc_feature 1..372: note = derived and/or modified sequence opt1 from anti-HIV_Chain
  source 1..372: mol_type = other RNA
gagatcgtgctgacccagagccccggcaccctctccctgagcccgggggagcgcgccacgctgtcctgccgggccagccagtccgtcagctcccgctacctcgcgtggtaccagcagaagcccggccaggcgccccggctgatcatctacgacgccagctcccgcgccagcgggatccccgaccggttctccggcagcgggtccgagaccgacttcaccctgaccatcacgcgcctcgagccggaggacttcgccgtgtactactgccagctgtacggcaccagccccaagttcaccttcggccaggggaccaagctggagatcaagcggacggtggccgccccctccgtcttcatcttcccgcccagcgac

SEQ ID NO: 11854 - RNA, 372 nt, synthetic construct
  misc_feature 1..372: note = derived and/or modified sequence opt1 from anti-HIV_Chain
  source 1..372: mol_type = other RNA
gagatcgtgctgacccagagccccggcaccctctccctgagccccggggagcgcgccacgctgtcctgccgggccagccagtccgtcagcaacaactacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgccacctccagcctgtacaccttcgggcagggcaccaagctcgagatcaagcgcacggtggccgccccctccgtcttcatcttcccgcccagcgac

SEQ ID NO: 11855 - RNA, 372 nt, synthetic construct
  misc_feature 1..372: note = derived and/or modified sequence opt1 from anti-HIV_Chain
  source 1..372: mol_type = other RNA
cccgccaccctggccgtgagcccgggcgagcgcgcgaccatctcctgcaagagctcccagaacctcctgtacagcgccaacaaccagcactccctggcctggtaccagcagcggcccgggcagccccccaagctcctgctgtactgggccagcacgcgcctctccggcgtcccggaccggttcagcgggtccggcagcgggaccgacttcaccctgaccatctccaacctgcaggccgaggacgtggcggtgtactactgccagcagtactacagccccccccccacgttcggccagggcaccaaggtcgagatccgccggaccgtggccgccccgtccgtgttcatcttcccccccagcgacgagcagctc

SEQ ID NO: 11856 - RNA, 372 nt, synthetic construct
  misc_feature 1..372: note = derived and/or modified sequence opt1 from anti-HIV_Chain
  source 1..372: mol_type = other RNA
cagcccgtgctgacccagccgcccagcgcctccggcgcccccgggcagcgcgtcaccatcagctgctccggcgggcccagcaacgtgggcgggaactacgtgtactggtaccggcagttcccgggcacggcgcccaacctcctgatcctgcgcgacgaccagcggccctccggcgtccccgaccgcttcagcgcctccaagagcgggaactccgccagcctcgccatcaccggcctgcggccggacgacgaggccttctacttctgcgcgacctacgactccgacgggagcatccgcctgttcggcgggggcaccgccctcacggtgctgtcccagcccaaggccgcccccagcgtgaccctgttcccgccc

SEQ ID NO: 11857 - RNA, 372 nt, synthetic construct
  misc_feature 1..372: note = derived and/or modified sequence opt1 from anti-HIV_Chain
  source 1..372: mol_type = other RNA
aacttcatgctgacccagcccccgagcgcctccggcgcccccgggcagcgcgtgaccatcagctgctccggcgggcccagcaacgtcggcgggaactacgtgtactggtaccggcagttccccggcacggcgcccaacctcctgatcctgcgcgacgaccagcggccctccggcgtgcccgaccgcttcagcgcctccaagagcgggaactccgccagcctcgccatctccggcctgcggcccgacgacgaggccttctacttctgcgcgacctacgacagcgacgggtccatccgcctgttcggcgggggcaccaccctcacggtcctgagccagccgaaggccgccccctccgtgaccctgttcccgccc

SEQ ID NO: 11858 - RNA, 372 nt, synthetic construct
  misc_feature 1..372: note = derived and/or modified sequence opt1 from anti-HIV_Chain
  source 1..372: mol_type = other RNA
gacatccagatgacccagagcccgccctccctgagcgcctccgtgggcgaccgcgtcaccatcacgtgccaggccagccaggacatcaacaacttcctcaactggtaccagcagaagcccgggaaggcgccccggctgctgatctacgacgcctccaacctcgagagcggcgtgtccagccgcttctccgggagccggtccggcaccgacttcaccctgaccatcagctccctgctccccgaggacatcgccacgtacagctgccagcagtactccaacctgccctacaccttcagccaggggaccaagctggagatcaagcgcaccgtggccgccccctccgtcttcatcttcccgcccagcgacgagcag

SEQ ID NO: 11859 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcaccgccgtgaagcgccccggggcctccgtgcgggtcagctgccaggcgtccggctacaccttcatcgaccacttcatctactggtggcgccaggccccggggcagggcctcgagtggctggggtggatcaaccccctgacgagccagccctcctaccccagccggttccagggccgcctcaccctgacccgggacaccttcgacgagatgctgtacatggacctccgcggcctgcggtccgacgacacggggatctacttctgcgcccgccggcacagcgactactgcgacttcgacatctggggctccgggacccagatcatcgtgagctccgccagcaccaagggc

SEQ ID NO: 11860 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccaggcctacggctacaagttcaccgaccacctgatctactggtggcggcaggccccggggcagggcctcgagtggatcgggtggatcaagcccgagaccggccagccctcctacagctacaagttccagggccgcgtgtccctgacgcgggacaccttccaggagatcctgttcatggacctccgcgggctgcggagcgacgacaccgccatctacttctgcgcccgccggcactccgactactgcgacttcgacgtgtggggcagcgggtcccaggtcatcgtgagctccgcgagcaccaagggc

SEQ ID NO: 11861 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccagacctacggctacaagttcaccgaccacctgatctactggtggcggcaggccccggggcagggcctcgagtggatggggtggatcaagcccgagacgggccagccctcctacagctaccgcttccagggccgggtgtccctgacccgcgacaccttcgaggagatcgtgttcatggacctgcgggggctccgcagcgacgacaccgccatctacttctgcgcccggcgccactccgactactgcgacttcgacgtctggggcagcgggtcccaggtgatcgtgagctccgccagcacgaagggc

SEQ ID NO: 11862 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccagacctacggctacaagttcaccgaccacctgatctactggtggcggcaggccccggggcagggcctcgagtggatcgggtggatcaagcccgagacgggccagccctcctacagctaccgcttccagggccgggtgtccctgacccgcgacaccttcgaggagatcgccttcatggacctgcgggggctccgcagcgacgacaccgccatctacttctgcgcccggcgccacacggactactgcgtgttcgacgtctggggctccgggagccagatcatcgtgtccagcgcgtccaccaagggc

SEQ ID NO: 11863 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcaccgccgtgaagcgccccggggcctccgtgcgggtcagctgccaggcgtccggctacaccttcacggactacttcatctactggtggcgccaggccccggggcagggcctcgagtggctggggtggatcaaccccctgaccagccagccctcctaccccagccggttccagggccgcctcaccctgacccgggacacgttcgacgagatgctgtacatggacctccgcggcctgcggtccgacgacaccgggatctacttctgcgcccgccggcacagcgactactgcgacttcgacatctggggctccgggacccagatcatcgtgagctccgccagcaccaagggc

SEQ ID NO: 11864 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccgtgcgcatcagctgccaggcctacggctacaagttcaccgaccacctgatctactggtggcggcaggccccggggcagggcctggagtggatcgggtggatcaagcccgagaccggccagccctcctacgcctacaagttccagggccgcgtgacgctcacccgggacaccttcgaggagatccacttcatggacctgcgcggggtccggaacgacgacaccgccacgtacttctgcgcgcgccggcacagcgactactgcgacttcgacgtgtggggctccgggagccaggtgatcgtctccagcgcctccaccaagggc

SEQ ID NO: 11865 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccgtgcgcatcagctgccagacctacggctacaagttcaccgaccacctgatctactggtggcggcaggccccggggcagggcctggagtggatcgggtggatcaagcccgagacgggccagccctcctacagctaccgcttccagggccgggtgtccctcacccgcgacaccttcgaggagatcgtcttcatggacctgcgggggctgcgcagcgacgacaccgccatctacttctgcgcccggcgccactccgactactgcgacttcgacgtgtggggcagcgggtcccaggtgctcgtcagctccgccagcacgaagggc

SEQ ID NO: 11866 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccagacctacggctacaagttcaccgaccacctgatctactggtggcggcaggccccggggcagggcctcgagtggatcgggtggatcaagcccgagacgggccagccctcctacagctaccgcttccagggccgggtgtccctgacccgcgacaccttcgaggagatcgtgttcatggacctgcgggggctccgcagcgacgacaccgccatctacttctgcgcccggcgccactccgactactgcgacttcgacgtctggggcagcgggtcccaggtgctggtgagctccgccagcacgaagggc

SEQ ID NO: 11867 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccgtgcgcatcagctgccagacctacggctacaagttcaccgaccacctgatccactggtggcggcaggccccggggcagggcctggagtggatcgggtggatcaagcccgacacgggccagccctcctacagctcccgcttccagggccgggtgagcctcacccgcgacaccttcgaggagatcgtcttcatggacctgcgggggctgcgctccgacgacaccgccatctacttctgcgcccggcgccacagcgactactgcgacttcgacgtgtggggctccgggagccaggtgctcgtctccagcgcctccacgaagggc

SEQ ID NO: 11868 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccagacctacggctacaagttcaccgaccacctgatctactggtggcggcaggccccggggcagggcctcgagtggatcgggtggatcaagcccgagacgggccagccctcctacagctaccgcttccagggccgggtgtccctgacccgcgacaccttcgaggagatcgtgttcatggacctgcgggggctccgcagcgacgacaccgccatctacttctgcgcccggcgccactccgactactgcgacttcgacgtctggggcagcgggtcccaggtgatcgtgagctccgccagcacgaagggc

SEQ ID NO: 11869 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccagacctacggctacaagttcaccgaccacctgatctactggtggcggcaggccccggggcagggcctcgagtggatcgggtggatcaagcccgagacgggccagccctcctacagctaccgcttccagggccgggtgtccctgacccgcgacaccttcgaggagatcgtgttcatggacctgcgggggctccgcagcgacgacaccgccatctacttctgcgcccggcgccactccgactactgcgacttcgacgtctggggcgggggcagccaggtgatcgtgtccagcgcctccacgaagggg

SEQ ID NO: 11870 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgcctgacctacggctacaagttcaccgaccacctcatctactggtggcggcaggccccggggcagggcctggagtggatcgggtggatcaagcccgagacgggccagccctcctacagctaccgcttccagggccgggtgtccctgacccgcgacaccttcgaggagatcgtgttcatggacctccgggggctgcgcagcgacgacaccgccatctacttctgcgcccggcgccactccgactactgcgacttcgacgtctggggcagcgggtcccaggtgatcgtgagctccgccagcacgaagggc

SEQ ID NO: 11871 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccaccctcaagaagcccggggcctccgtgcgcatcagctgccaggcgtacggctacaagttcaccgaccacctgatccactggtggcggcaggccccggggcagggcctggagtggatcgggtggatcaagcccgagacgggccagccctcctacgcctacaagttccagggccgcgtgagcctcacccgggacaccttcgaggagatcctgttcatggacctgcgcgggctccggtccgacgacaccgccatctacttctgcgcccgccggcacagcgactactgcgacctggacgtctggggcgggggcacgcagctgctcgtgtccagcgcgtccaccaagggg

SEQ ID NO: 11872 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccgtgcgcatcagctgccaggcctacggctacaagttcaccgaccacctgatctactggtggcggcaggccccggggcagggcctggagtggatcgggtggatcaagcccgagaccggccagccctcctacagctacaagttccagggccgcgtgacgctcacccgggacaccttcgaggagatccacttcatggacctgcgcgggctgcggtacgacgacaccgccacgtacttctgcgcccgccggcactccgactactgcgacttcgacgtctggggcagcgggtcccaggtgagcgtgtccagcgcgtccaccaagggc

SEQ ID NO: 11873 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccaggcctacggctacaagttcaccgaccacctgatctactggtggcggcaggccccggggcagggcctcgagtggatcgggtggatcaagcccgagaccggccagccctcctacagctacaagttccagggccgcgtgtccctgacgcgggacaccttccaggagatcctgttcatgaacctccgcgggctgcggagcgacgacaccgccatctacttctgcgcccgccggcactccgactactgcgacttcgacgtgtggggcagcgggtcccagatcctggtcagctccgcgagcaccaagggc

SEQ ID NO: 11874 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcaccgccgtgaagaagcccggggcctccgtgcgcgtcagctgccaggcgtccggctacaccttcacggactacttcatctactggtggcggcaggccccggggcagggcctcgagtggctggggtggatcaacccccgcaccagccagccctcctacccctaccggttccagggccgcgtgaccctgacccgggacatcttcgaggagatgctctacatggacctgcgcggcctgcggagcgacgacacggggatctacttctgcgcccgccggcactccgactactgcgacttcgacatctggggcagcgggacccagatcatcgtgtccagcgcctccaccaagggc

SEQ ID NO: 11875 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgccctcaagaagcccggggcgtccctgcgcatcagctgccaggcctacggctacaagttcaccgactacctgatccactggtggcggcaggccccggggcagggcctcgagtggatcgggtggatcaagcccgagaccggccagccctcctacagctacaagttccagggccgcgtgtccctgacgcgggacaccttcgaggagatcctgttcatggacctccgcgggctgcggagcgacgacaccgccatctacttctgcgcccgccggcactccgactactgcgacttcgacgtgtggggcgggggcagccaggtcctggtgtccagcgcgtccaccaagggg

SEQ ID NO: 11876 - RNA, 372 nt, synthetic construct
  misc_feature 1..372: note = derived and/or modified sequence opt1 from anti-HIV_Chain
  source 1..372: mol_type = other RNA
gaggtgcagctgctcgagagcggcggggccctggtccagcccggcgggtccctgcgcctcagctgcgccgcgtccggcttcaccttcagcacctccagcatgtcctgggtgcggcaggccccggggaagggcctggagtgggtgagcgccatcggctccgggcgcggcagcacgttctacgccgactccgtcaaggggcggttcaccatcagccgcgacaactccaagaacaccctgagcctccagatgaactccctgaccgccgaggacacggcgacctactactgcaccaagaccggcgggctgctccggttccccgaggtgtggggcaagggcacgaccgtgaccgtcagctccgccagcaccaagggg

SEQ ID NO: 11877 - RNA, 372 nt, synthetic construct
  misc_feature 1..372: note = derived and/or modified sequence opt1 from anti-HIV_Chain
  source 1..372: mol_type = other RNA
gaggtgcagctggtcgagagcggcgggggcctcgtgaagcccgggggctccctgcgcctgagctgcgccgactccgggttcaccttccggagctactccatgcactgggtgcgccaggccccgggcaagggcctcgcgtgggtcagctccatcagctccaccagcaactacatctactacgccgactccgtgaaggggcggttcacgatcagccgcgacaacgccaagaactccctgtacctgcagatgaacagcctccgggccgaggacaccgccgtgtactactgcgcgcgcaccttcatcaccgcctcctggttcgacagctggggccaggggacgctggtcaccgtgtccagcgcctccaccaagggc

SEQ ID NO: 11878 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgaggtgaagaagcccggggcctccgtgaaggtcagctgcaaggcgtccggctacaccttcaccaactacggggtgagctgggtgcgccaggccccgggccaggggctcgagtggatgggctggatctccccctacagcggcaacacgaactacgcccagcggctgcaggaccgcgtcaccatgaccaccgacacgtccaccaacaccgcctacatggagctgcggagcctccgctccgacgacaccgccgtgtactactgcgcggcccggagctactactactactccatggacgtgtgggggcagggcacgaccgtcaccgtgagctccgccagcaccaagggg

SEQ ID NO: 11879 - RNA, 372 nt, synthetic construct
  misc_feature 1..372: note = derived and/or modified sequence opt1 from anti-HIV_Chain
  source 1..372: mol_type = other RNA
caggtgcagctggtccagagcggcgccgagctcaagaagcccgggtccagcgtgaaggtgtcctgcaaggccagcggcgggaccttctccaactacgcgatcaactgggtccgccaggccccgggccaggggttcgagtggatgggcggcatcatccccctgttcgccacccccacgtacgcccagaagttccaggggcgggtgcgcatcaccgccgacgacagcacctccaccgcgtacatggagctgagctccctccggagcgacgacacggccgtgtacttctgcgcccgccccaacgtcgtgcggtccgccctggactactggggccaggggaccctggtgaccgtcagctccgcgagcaccaagggc

SEQ ID NO: 11880 - RNA, 372 nt, synthetic construct
  misc_feature 1..372: note = derived and/or modified sequence opt1 from anti-HIV_Chain
  source 1..372: mol_type = other RNA
caggtgcagctggtcgagagcggcgggggcgtggtgcagcccgggaagtccctccgcctgagctgcgccgcctccggcttcaccttcagcacccacgcgatgcactgggtccggcaggccccggggaagggcctggactgggtggccgtgatctcccacgacggcgacaaccagtactacgccgacgccgtcaaggggcgcttcacgatcagccgggacgactcccgcgacaccgtgttcctccagatgaacagcctgcggaccgaggacaccggcgtgtactactgcgcggccgactccagcgggtccaactggttcgactactggggccaggggatcctggtcacggtgagctccgccagcaccaagggc

SEQ ID NO: 11881 - RNA, 375 nt, synthetic construct
  misc_feature 1..375: note = derived and/or modified sequence opt1 from anti-HIV_Chain
  source 1..375: mol_type = other RNA
caggtgcgcctgagccagtccggcgggcagatgaagaagcccggcgagagcatgcggctctcctgccgcgccagcgggtacgagttcctgaactgcccgatcaactggatccggctggcccccggccgccggcccgagtggatggggtggctcaagccccgcggcggcgcggtcaactacgcccggaagttccaggggcgcgtgaccatgacccgggacgtgtactccgacacggccttcctggagctgcgcagcctcacctccgacgacaccgccgtctacttctgcacccggggcaagtactgcacggcccgcgactactacaactgggacttcgagcactgggggcggggcgcgccggtgaccgtgagctcc

SEQ ID NO: 11882 - RNA, 375 nt, synthetic construct
  misc_feature 1..375: note = derived and/or modified sequence opt1 from anti-HIV_Chain
  source 1..375: mol_type = other RNA
gaggtgcagctggtccagagcggctccgacgtgcgcaagcccggggccaccgtgaccgtcagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagc

SEQ ID NO: 11883 - RNA, 375 nt, synthetic construct
  misc_feature 1..375: note = derived and/or modified sequence opt1 from anti-HIV_Chain
  source 1..375: mol_type = other RNA
caggtgcagctggtccagagcggcgggggcctcgtgcagcccggggagtccctgcgcctgagctgcaccgcctccggcttcaccttcagctcctacaacatgaactgggtgcggcaggccccggggaagggcctcgagtggatcagctacatctccgacaagagcaagaacaagtactacgcggactccgtccgcggccggttcacgatcagccgcgacaacgcccagaactccctgttcctgcagatgagctccctccgggacgaggacaccgccgtgtactactgcacccgcgaggggccccagcggagcttctacttcgactactggggccaggggatccaggtgaccgtctccagcgcctccacgaagggc

SEQ ID NO: 11884 - RNA, 375 nt, synthetic construct
  misc_feature 1..375: note = derived and/or modified sequence opt1 from anti-HIV_Chain
  source 1..375: mol_type = other RNA
gaggtgcagctggtcgagagcggcgccgaggtgaagaagcccgggtccagcgtgaaggtctcctgcaaggccagcggcgggaccttctccagctactccatcagctgggtgcgccaggcgccgggccaggggctcgagtggatgggcggcatcatccccatcttcgccaccacgcactacgggcagaagttccagggccggatcaagatcaccgccgacaagtccaccagcaccgcctacatggagctgtcccgcctgcggagcgaggacacggccgtgtactactgcgcgcgcgaccgggagttctacttctacgggatggacgtctggggccaggggaccaccgtgaccgtgtccagcgcctccacgaagggc

SEQ ID NO: 11885 - RNA, 375 nt, synthetic construct
  misc_feature 1..375: note = derived and/or modified sequence opt1 from anti-HIV_Chain
  source 1..375: mol_type = other RNA
cagctgcagctccaggagagcggccccgggctggtgaagccgtgggagaccctggtcctgacctgctccgtgagcggcgggtccatcagctccggcgactactactgggggtggatccgccagagccccggcaagggccccgagtggatcgggaacatcttctactccagcggcaacacgtactacaacacctccctcaagagccgggtgaccatctccgtcgacgtgagcaagaaccgcttctccctgaagctcaccagcatgacggccgccgacaccgcggtgtactactgcgggcggctgtccaacaagggctggttcgacccctgggggcagggcaccctggtcagcgtgtccagcgcctccaccaagggc

SEQ ID NO: 11886 - RNA, 375 nt, synthetic construct
  misc_feature 1..375: note = derived and/or modified sequence opt1 from anti-HIV_Chain
  source 1..375: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgacaccgacttcaccctcacgatcagctccctggagccggaggacttcgccgtgtactactgccagcagcgggggatctggcccctgcagatcaccttcggccagggcacccgcctcgagatcaagcggaccgtggccgcccccagcgtcttcatcttcccgccctccgacgag

SEQ ID NO: 11887 - RNA, 375 nt, synthetic construct
  misc_feature 1..375: note = derived and/or modified sequence opt1 from anti-HIV_Chain
  source 1..375: mol_type = other RNA
agcgagatcgtgctgacccagtcccccggcaccctcagcctgtccccgggggagcgcgccacgctgagctgccgggcctcccagagcgtctccagctcctacctcgcgtggtaccagcagaagcccgtgcaggcgccccgcctgctgatctacggcgccagctcccgggccaccgggatccccgaccgcttcagcggctccgggagcggcaccgacttcaccctcacgatctcccggctggagccggaggacttcgccgtgtactactgccagcagtacggcaccctgcacccccgcaccttcgggcagggcaccaaggtcgagatcaagcggacggtggccgcccccagcgtgttcatcttcccgccctccgac

SEQ ID NO: 11888 - RNA, 375 nt, synthetic construct
  misc_feature 1..375: note = derived and/or modified sequence opt1 from anti-HIV_Chain
  source 1..375: mol_type = other RNA
agccaggccgtggtcacccagcccccgtccgtgagcggcgcccccgggcagcgcgtgaccatctcctgcagcggcgggccctccaacgtcggcgggaacctggtgtactggtacaagcagttccccggcacggcgcccaagctcctgatccggcgcgacgaccagcggcccagcggcgtgcccgaccgcttctccgggagcaagtccggcaacagcgcctccctggccatcagcgggctccggcccgacgacgaggccttctacttctgcgccacctacgactcccacggcagcatccgcctgttcgggggcggcaccctgctcaccgtcctgtcccagccgaaggcggcccccagcgtgacgctgttcccgccc

SEQ ID NO: 11889 - RNA, 375 nt, synthetic construct
  misc_feature 1..375: note = derived and/or modified sequence opt1 from anti-HIV_Chain
  source 1..375: mol_type = other RNA
gacatccagatgacccagagcccctccaccctggccgccagcatcggcgggacggtgcgcgtctcctgccgggcgagccagtccatcaccggcaactgggtggcctggtaccagcagcgccccgggaaggcgccccggctcctgatctaccgcggcgccgccctgctcgggggcgtgcccagccggttctccggcagcgccgccgggaccgacttcaccctgacgatcggcaacctgcaggccgaggacttcgggaccttctactgccagcagtacgacacctaccccggcaccttcgggcagggcacgaaggtcgaggtgaagcgcaccgtggccgcgccgtccgtcttcatcttcccgcccagcgacgagcag

SEQ ID NO: 11890 - RNA, 375 nt, synthetic construct
  misc_feature 1..375: note = derived and/or modified sequence opt1 from anti-HIV_Chain
  source 1..375: mol_type = other RNA
gagatcgtgatgacccagagccccgacaccctgtccgtcagccccggcgagcgcgccacgctctcctgccgggccagccagtccgtgaacagcaacctggcgtggtaccagcagaagcccgggcaggcgccccgcctgctcatctacggcgcctccacccgggccaccgccgtgcccgcccgcttcagcgggtccggcagcgggaccgagttcacgctgaccatctccagcctgcagtccgaggacagcgccgtctactactgccagcagtactaccagtggctctcctacaccttcggccagggcaccaagctggagatcaagcggacggtggccgccccgagcgtgttcatcttcccgccctccgacgagcag

SEQ ID NO: 11891 - RNA, 375 nt, synthetic construct
  misc_feature 1..375: note = derived and/or modified sequence opt1 from anti-HIV_Chain
  source 1..375: mol_type = other RNA
cgccaggtgcagctggtccagagcggcgccgccctcaagaagcccggggcgtccctgcggatcagctgccaggcctacggctacaagttcaccgaccacctgatctactggtggcgccaggccccggggcagggcctcgagtggatcgggtggatcaagcccgagaccggccagccctcctacagctacaagttccagggccgggtgtccctgacgcgcgacaccttccaggagatcctgttcatggacctccgggggctgcgcagcgacgacaccgccatctacttctgcgcccggcgccactccgactactgcgacttcgacgtgtggggcagcgggtcccagatcctggtcagctccgcgagcaccaagggc

SEQ ID NO: 11892 - RNA, 375 nt, synthetic construct
  misc_feature 1..375: note = derived and/or modified sequence opt1 from anti-HIV_Chain
  source 1..375: mol_type = other RNA
caggtgcagctggtccagagcggcgccgccctcaagaagcccggggcgtccgtgcgcatcagctgccaggcctacggctacaagttcaccgactacctgatccactggtggcggcaggccccggggcagggcctggagtggatcgggtggatcaagcccgagaccggccagccctcctacagctacaagttccagggccgcgtgacgctcacccgggacaccttcgaggagatcctgttcatggacctgcgcgggctccggtccgacgacaccgccatctacttctgcgcccgccggcacagcgactactgcgacttcgacgtctggggctccgggagccaggtgatcgtgtccagcgcgtccacgaagggcgcc

SEQ ID NO: 11893 - RNA, 375 nt, synthetic construct
  misc_feature 1..375: note = derived and/or modified sequence opt1 from anti-HIV_Chain
  source 1..375: mol_type = other RNA
gaggtgcagctggtcgagagcggcgggggcctcgtgaagcccgggggctccctgcgcctgagctgcgccgcctccgggttcagcttctccgagcactacatgagctggatccggctcgcgccgggcaagggcctggagtggctgtcctacatcagctccagcacccgcaccacgtactccgccgacagcgtgcgggggcgcttcaccatctcccgggacaccgccaagcagctcctgttcctgcacatgagctccctccgcgccgaggacaccgccgtctactactgcgtgcggctgtacggcgggatcaacggctggttcgaccagtgggggcagggcacgctggtgagcgtctccagcgcgtccaccaagggc

SEQ ID NO: 11894 - RNA, 375 nt, synthetic construct
  misc_feature 1..375: note = derived and/or modified sequence opt1 from anti-HIV_Chain
  source 1..375: mol_type = other RNA
caggtgcagctggtccagagcggccccgggctcgtgaagccgtccgagaccctgagcctgacctgctccgtgagcaacggctccatcagctccgggggctactactggagctggctccgccagttccccgggaagggcctggagtggatcggctccatccactacacggggcggaccttctacaaccccagcctgatgggccgcaccgccctctccatggacaccagcaacaaccagttctccctgaaggtcagctccgtgacggccgcggacaccgccctgtactactgcgcccgggagctccagtggatgttcgtggtcgacccctgggggcagggcaccctggtgaccgtgagctccgccagcacgaagggg

SEQ ID NO: 11895 - RNA, 375 nt, synthetic construct
  misc_feature 1..375: note = derived and/or modified sequence opt1 from anti-HIV_Chain
  source 1..375: mol_type = other RNA
caggtgcagctgcaggagagcggccccgggctcgtcaagccgtccgagaccctgagcctgacctgctccgtgagcaacggctccatcagctccgggggctactactggagctggctccgccagttccccgggaagggcctggagtggatcggctccatccactacacggggcggaccatgtacaaccccagcctgatgggccgccccgccctctccatggacaccagcaacaaccagttctccctgaagctgcggagcgtgaccgccgcggacacggccctctacttctgcgcccgcgacctgcagtggatcttcgtcgtggacccgtgggggcagggcaccctggtgaccgtctccagcgcctccaccaagggg

SEQ ID NO: 11896 - RNA, 375 nt, synthetic construct
  misc_feature 1..375: note = derived and/or modified sequence opt1 from anti-HIV_Chain
  source 1..375: mol_type = other RNA
gaggtgcagctgctcgagagcggcgggggcctggtccagcccgggggctccctgcgcctcagctgcgccgtgtccgggttcaccttcggcggccacgccgtgagctgggtccggcaggcgccggggaagggcctggagtggctgtcccagatcagcgggaccggctcccgcacggactacgccgacgccgtgaaggggcggttcaccgtgagccgcgacaactccaagaagaccgtctacctccagatgaacagcctgcgggtggaggacaccgccctgttctactgcgccacgcgctcccccggcggcgggtacgcgttcgacatctggggccagggggccatggtgaccgtcagctccgccagcaccaagggc

SEQ ID NO: 11897 - RNA, 375 nt, synthetic construct
  misc_feature 1..375: note = derived and/or modified sequence opt1 from anti-HIV_Chain
  source 1..375: mol_type = other RNA
caggtgcagctggtccagagcggcgccgaggtgaagaagcccgggtccagcgtgaaggtctcctgcaaggtgagcttcttctccaactacggcatcagctgggtgcgccagcggccggggcagggcctcgagtggatggggcgcatcatccccgccatcgacgacatgacctacgcgcagaccttccggggccgcgtcacgttctccgccgacaagttcaccaccaccgcctacatggagctgacgggcctgaccttcgaggacaccgccacctacttctgcgcccgggacccccaggtgaaccgccgggggaactgcttcgaccactggggccaggggacgctcgtgaccgtcagctccgcgagcaccaagggc

SEQ ID NO: 11898 - RNA, 375 nt, synthetic construct
  misc_feature 1..375: note = derived and/or modified sequence opt1 from anti-HIV_Chain
  source 1..375: mol_type = other RNA
caggtgcagctgcaggagagcggccccgggctcgtcaagccctccgagaccctgagcctgacctgcacggtgtccggcgggagcatctcctactactactggagctggatccgccagccgcccggcaaggggctcgagtggatcggcgacatctactactccggcaccaccgactacaaccccagcctgaagtcccgggtgaccatcagcgtcgacacgtccaagaaccagttcagcctgaagctctccagcgtgaccgccgccgacaccgcggtgtactactgcgcccgccggcgcgggcagcggctgctggcctacttcgactactggggccaggggtccctcgtcaccgtgagctccgccagcacgaagggc

SEQ ID NO: 11899 - RNA, 375 nt, synthetic construct
  misc_feature 1..375: note = derived and/or modified sequence opt1 from anti-HIV_Chain
  source 1..375: mol_type = other RNA
caggtgcagctgcaggagagcggccccgggccggtcaagccctccgagaccctcagcctgacctgcacggtgtccggcgggagcatgatctcctactactggagctggatccgccagccgcccggcaaggggctggagtggatcggctacatcttcaccaacggccggaccacctactcccccagcctccgctcccgggtgacgatcagcctggacacctccaccaaccacttcagcctgcgcctcaagtccgtcaccgccgccgacacggcgatctactactgcgcccggctggacggggaggccttccgctactacctggacctctggggccaggggaacctggtgaccgtgagctccgccagcaccaagggc

SEQ ID NO: 11900 - RNA, 375 nt, synthetic construct
  misc_feature 1..375: note = derived and/or modified sequence opt1 from anti-HIV_Chain
  source 1..375: mol_type = other RNA
caggtgcagctggtccagagcggcgccgaggtgaagaagcccggggcctccgtgaaggtcagctgcaagccgtccagcaacaccttcacctcccactacatccactgggtgcgccaggcgcccggccaggggctcgagtggatgggcatgatcaaccccgggggcagcacgcggtacgcccccaagttccagggccgcgtgaccctgacccgggacacctccacgcgcaccgtctacatggagctgagctccctccggagcgaggacaccgccgtgtactactgcgcccgcccgcagtacaacctggggcgggaccccctggacgtgtggggcctcgggaccatggtcacggtgtccagcgcctccaccaagggc

SEQ ID NO: 11901 - RNA, 375 nt, synthetic construct
  misc_feature 1..375: note = derived and/or modified sequence opt1 from anti-HIV_Chain
  source 1..375: mol_type = other RNA
caggtgcagctgcagcagtggggcgccgggctcctgaagcccagcgagaccctgtccctgacctgcgccgtctacggcgggagcttctccggctactactggagctggatccgccagccgcccgggaagggcctggagtggatcggcgagatcaaccactccgggagcacgaactacaacccctccctcaagagccgggtgaccatctccgtggacaccagcaagaaccagttctccctcaagctgagctccgtcaccgcggccgacacggccgtgtactactgcgcccgcctgcccatcggcagcgggtggtacggccgggactactgggggcagggcaccctcgtgaccgtctccagcgcctccaccaagggc

SEQ ID NO: 11902 - RNA, 375 nt, synthetic construct
  misc_feature 1..375: note = derived and/or modified sequence opt1 from anti-HIV_Chain
  source 1..375: mol_type = other RNA
caggtgcagctggtccagagcggcgccgaggtgaagaagcccggggcctccgtgaaggtcagctgcaaggcgtccggcaacaccttcaccagctacgggatcacgtgggtgcgccaggccccgggccaggggctcgagtggatgggctggatctccgcctacaacggcaacaccaactacgcccagaagctgcaggaccggctgaccatgaccacggacaccagcacctccaccgcctacatggagctccgcagcctgcggtccgacgacacggcggtgtactactgcgccttcagccgccactacgggtccggcaactacgactactgggggcagggcaccctggtcaccgtgagctccgccagcaccaagggg

SEQ ID NO: 11903 - RNA, 375 nt, synthetic construct
  misc_feature 1..375: note = derived and/or modified sequence opt1 from anti-HIV_Chain
  source 1..375: mol_type = other RNA
cagttccgcctggtgcagagcggccccgaggtcaagaacccggggtccagcgtgaccgtgtcctgcaaggccagcggcgggaccttctccggcctcgggatcaactgggtccggcaggcccccggccagggcctggagtggctgggggacatcaagacgatgtacggcaccaccaactacgcgcccaagttccaggggcgcgtgaccatcacggccgacgagagcacctccaccagctacatggagctctccggcctgcggagcgaggacaccgccgtgttctactgcgtccgcgagctgttcgggcaccaccccgccttcggcgtgtggggccaggggacgtccgtgatcgtcagctccgccagcaccaagggc

SEQ ID NO: 11904 - RNA, 375 nt, synthetic construct
  misc_feature 1..375: note = derived and/or modified sequence opt1 from anti-HIV_Chain
  source 1..375: mol_type = other RNA
cgcgtgcagctggtccagagcggcgccgaggtgaagaagcccgggtccagcgtgaccgtctcctgcaaggccagcggcgggtccttcagctcctacgcgatcagctgggtgcggcaggccccgggccaggggctcgagtgggtgggcggcgtcaaggtgatgttcgggaccgtgcactactcccagaaggtccagggccgcgtgacgatcaccgccgacgacagcaccgggacctcctacctggagctgagcggcctccggtccgccgacacggccgtgtactactgcgcgcgcaacgccggggcctacttctaccccttcgacatctggggccagggcaccctgatcatcgtcagctccgccagcaccaagggg

SEQ ID NO: 11905 - RNA, 375 nt, synthetic construct
  misc_feature 1..375: note = derived and/or modified sequence opt1 from anti-HIV_Chain
  source 1..375: mol_type = other RNA
caggtgcagctgcaggagagcggccccgggctcgtcaagccctccgagaccctgagcctgacctgcacggtgtccggcgggagcatctccagccgctcctactactggggctggatccggcagccgcccgggaagggcctcgagtgggtgggcagcatctactacaccgggtccacctactacagcccctccctcaagagccgcgtcaccatctccgtggacacgagccagaaccagttctccctgaagctgaacagcgtgaccgccgccgacaccgcggtctactactgcgcccggcagaagggctccgggaccagcctgctgtactggggccaggggacgctcgtgaccgtgtccagcgccagcaccaagggc

SEQ ID NO: 11906 - RNA, 375 nt, synthetic construct
  misc_feature 1..375: note = derived and/or modified sequence opt1 from anti-HIV_Chain
  source 1..375: mol_type = other RNA
caggtgcagctggtccagagcggcaccgaggtgaagaagcccgggtccagcgtgaaggtctcctgcaaggccagcggcgggaccttctccgacagcgacatcgcctgggtgcgccaggcgccgggccaggggctcgagtggatgggcggcatcacgcccatgttcgacatggccaagtccgcccagaagttccgggggcgcctgatcatcaccgccgacaagagcaccggcaccgcctacatggagctgtccagcctccggtacgaggacgcggccgtgtacttctgcgcccgctccagcgggaacttcgagttcgccttcgagatctggggccaggggacgaagatcatcgtctccctggcgagcaccaagggc

SEQ ID NO: 11907 - RNA, 375 nt, synthetic construct
  misc_feature 1..375: note = derived and/or modified sequence opt1 from anti-HIV_Chain
  source 1..375: mol_type = other RNA
gtggtccagctggtgcagagcggcaccgaggtgaagaagcccgggtccagcgtcaaggtgtcctgcaaggccagcggcgggaccttctccggcagcgacatctcctgggtgcgccaggccccggggcagggcctcgagtggatgggcgggatcatccccatgttcgacatcgaggaccacgcgcagaagttccggggccgcctgacgatcaccgccgacaagagcaccggggccgcctacatggagctgtccagcctccggtccgaggacgccgcggtctactactgcgcccgcagctccggcaactacgacttcgccttcgacatctgggggcagggcacccggctgatcgtgagctccgccagcacgaagggc

SEQ ID NO: 11908 - RNA, 375 nt, synthetic construct
  misc_feature 1..375: note = derived and/or modified sequence opt1 from anti-HIV_Chain
  source 1..375: mol_type = other RNA
gtggtccagctggtggagagcggcaccgaggtgaagaagcccgggtccagcgtcaaggtgtcctgcaaggccagcggcgggaccttctccggcagcgacatctcctgggtgcgccaggccccggggcagggcctcgagtggatgggcgggatcatccccatgttcgacatcgagaaccacgcggagaagttccggggccgcctgacgatcaccgccgtcaagagcaccggggccgcctacatggagctgtccagcctccggtccgaggacgccgcggtgtactactgcgcccgcagctccggcaactacgacttcgcctacgacatctgggggcagggcacccgggtgatcgtcagctccgccagcacgaagggc

SEQ ID NO: 11909 - RNA, 378 nt, synthetic construct
  misc_feature 1..378: note = derived and/or modified sequence opt1 from anti-HIV_Chain
  source 1..378: mol_type = other RNA
caggtgcagctggtccagagcggctccgccatgaagaagcccggggccagcgtgcgcgtgtcctgctggaccagcgaggacatcttcgacaccacggagctcatccactgggtccggcaggcgccgggccaggggctggagtggatcggctgggtgaaggccgtgtccggggccgtcaactacggcagcctggacttccgccaccgggtgtccctcacccgcgaccgggacctgagcaccgcccacatggacatccgcggcctgacccaggacgacacggccacctacttctgcgcgcggcagaagttcgcccgcggggaccagggctggttcttcgacctctgggggcggggcaccctgatcgtggtctccagcgcc

SEQ ID NO: 11910 - RNA, 378 nt, synthetic construct
  misc_feature 1..378: note = derived and/or modified sequence opt1 from anti-HIV_Chain
  source 1..378: mol_type = other RNA
caggtgcagctgcaggagagcggccccgggctcgtcaagccgtccgagaccctgagcctgacctgcacggtgtccggcgggagcatctccaaccactactggagctggatccgccagccgcccggcaaggggctcgagtggatcggctacatctaccactccggcaacatcaactacaagagctccctcaagagccgggccaccatctccatcgacaccagcaacaaccagttctccctgaagctgagctccgtgatcgccgcggacaccgccgtctactactgcgcccgcaacttcgggcccggcagccccaactacgggatggacgtgtggggccaggggacgaccgtgaccgtctccagcgcctccaccaagggc

SEQ ID NO: 11911 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgggggcgtggtgcagcccgggcgctccctccggctgagctgcgccgcctccggcttcaccttcagccaccacgggatccactgggtccgccaggcgccgggcgagggcctggagtgggtggccgtgatctccgaggacgggaccaacatccactacgaggacagcgtccggggccgcttcacgatctcccgggacaacagcaagaacaccgtggacctccagatgaactccctgcgcgccgaggacaccgccgtgtactactgcgccagcctgatctccatgcgggacggggacgcgttcgacctctggggccaggggacccgcgtcacggtgagctccgccagcaccaagggc

SEQ ID NO: 11912 - RNA, 378 nt, synthetic construct
  misc_feature 1..378: note = derived and/or modified sequence opt1 from anti-HIV_Chain
  source 1..378: mol_type = other RNA
caggtgcagctggtcgagagcggcgggggcctcgggcagcccggcgggtccctgcgcctgagctgcgccgcctccggcttcaccttccggaactacgcgatgagctgggtgcgccaggccgccggcaaggggctcgagtgggtgtccggcgtcagcgggggcggggacaccacgtactacggcgactccgtgaagggccggttcaccatcagccgcgacaactccaagaacaccctgtacctgcagatgaacaacctccgggccgaggacaccgccgtgtactactgcgcgaaggacaagggggtctggggcagctccgacttcgactactgggggcagggcacgctggtgaccgtgagctccgccagcaccaagggc

SEQ ID NO: 11913 - RNA, 378 nt, synthetic construct
  misc_feature 1..378: note = derived and/or modified sequence opt1 from anti-HIV_Chain
  source 1..378: mol_type = other RNA
gaggtgcagctggtcgagagcggcgggggcgtggtgcagcccgggcgctccctccggctgagctgcgccgcctccggcttcaccttcagccaccacgggatccactgggtccgccaggcgccgggcgagggcctggagtgggtggccgtgatctccgaggacgggaccaacatccactacgaggacagcgtccggggccgcttcacgatctcccgggacaacagcaagaacaccgtggacctccagatgaactccctgcgcgccgaggacaccgccgtgtactactgcgccagcctgatctccatgcgggacggggacgcgttcgacctctggggccaggggacccgcgtcacggtgagctccgccagcaccaagggc

SEQ ID NO: 11914 - RNA, 378 nt, synthetic construct
  misc_feature 1..378: note = derived and/or modified sequence opt1 from anti-HIV_Chain
  source 1..378: mol_type = other RNA
cgcggccccgtgaccctggccgtcagcctcggggagcgggccaccatcacgtgcaagtccagccagtccgtgctggtgcacagcaacaacaagaactacctgtcctggtaccagcagaagcccggccagccgcccaagctcctgatctactgggcgagcacccgcgagtccggggtccccgagcggttcagcggctccgggagcggcaccgacttcaccctgtccatcagctccctccaggccgaggacgtggccgtgtactactgccaccagtacttcagcacgccccgcaccttcggccaggggaccaaggtcgagatcaagggcaccgtggccgccccctccgtgttcatcttcccgcccagcgacgagcagctg

SEQ ID NO: 11915 - RNA, 378 nt, synthetic construct
  misc_feature 1..378: note = derived and/or modified sequence opt1 from anti-HIV_Chain
  source 1..378: mol_type = other RNA
agcgagatcgtgatgacccagtcccccgccaccctgagcatgtcccccggcgagcgcgccacgctcagctgccgggcgtccctgagcgtcaacaccaacctggcctggtaccagcagaagcccgggcaggcgccccgcctcctgatctacggcgcctccacccgggccaccgggatccccgcccgcttcagcggctccgggagcggcacggagttcaccctgaccatctccagcctccagtccgaggacttcgccctgtactactgccagcagtacaaccactggccgcagaccttcggccaggggacgaaggtggagatcaagcggaccgtggccgcccccagcgtcttcatcttcccgccctccgacgagcagaag

SEQ ID NO: 11916 - RNA, 378 nt, synthetic construct
  misc_feature 1..378: note = derived and/or modified sequence opt1 from anti-HIV_Chain
  source 1..378: mol_type = other RNA
agcgagatcgtgctgacccagtcccccgccaccctcagcctgtcccccggcgagcgcgccacgctgagctgccgggcgtcccagagcatcaacaactacctcgcctggtaccagcagaagcccgggcaggcgccccgcctgctgatctacgacgcctccaaccgggccaccggcatccccgcccgcttcagcgggggcgggtccggcaccgacttcaccctcacgatcagctccctggagccggaggacttcgccgtctactactgccagcagcgggccaactggcgcctgctcaccttcggcgggggcaccaaggtggagatcaagcggaccgtggccgcgcccagcgtcttcatcttcccgccctccgacgagcag

SEQ ID NO: 11917 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcggggccgtgaagaagcccggcgcctccgtgaaggtcagctgcgagacctacgggtacaccttcacggaccacttcatgcactggtggcgccaggcgccgggccaggggctcgagtggatgggctggatcaacccctactccagcgccgtgtcctacagcccccggtaccagggccgcgtgaccatgacccgggacaccttcctggagacggtctacatggagctgcgcgggctcaagttcgacgacaccgccatctactactgcgccacccccaagtccggccgggactactggagcttcgacctgtgggggcagggcaccctggtgacggtgtccagcgcctccaccaagggg

SEQ ID NO: 11918 - RNA, 378 nt, synthetic construct
  misc_feature 1..378: note = derived and/or modified sequence opt1 from anti-HIV_Chain
  source 1..378: mol_type = other RNA
agccaggtgcagctggtcgagtccggccccgggctcgtgaagccgagcgagaccctgtccctgacctgcagcgtgtccaacggcagcatctccagcgggggctactactggtcctggctccgccagttccccgggaagggcctggagtggatcggcagcatccactacacggggcggaccatgtacaacccctccctgatgggccgccccgccctcagcatggacacctccaacaaccagttcagcctgaagctgtccagcgtcaccgccgcggacacggccctctacttctgcgcccgggacctgcagtggatcttcgtggtggacccgtgggggcagggcaccctggtcaccgtgtccagcgcctccaccaagggg

SEQ ID NO: 11919 - RNA, 378 nt, synthetic construct
  misc_feature 1..378: note = derived and/or modified sequence opt1 from anti-HIV_Chain
  source 1..378: mol_type = other RNA
agcgtggtccagctggtggagtccggccccgggctcgtgaagccgagcgagaccctgtccctgacctgcagcgtctccaacggcagcatctccagcgggggctactactggtcctggctccgccagttccccgggaagggcctggagtggatcggcagcatccactacacggggcggaccatgtacaacccctccctgatgggccgccccgccctcagcatggacacctccaacaaccagttcagcctgaagctgcggtccgtgaccgccgcggacacggccctctacttctgcgcccgcgacctgcagtggatcttcgtggtcgacccgtgggggcagggcaccctggtgaccgtgagctccgccagcaccaagggg

SEQ ID NO: 11920 - RNA, 378 nt, synthetic construct
  misc_feature 1..378: note = derived and/or modified sequence opt1 from anti-HIV_Chain
  source 1..378: mol_type = other RNA
agcggcgggcgcctggtgcagcccggcgggtccctccggctgagctgctccgccagcggcttcaccctgtccaacagcgccatgtcctgggtccgccaggcgccggggaagggcctcgagtgggtgagctccatcctgagctccggcgtggggaccttctacgccgacagcgtcaagggccggttcacggtgtcccgcgacaacagccggaacaccctgtacctccagatgaagtccctgcgcgccgaggacaccgccctgtactactgcgccaaggtgcagatccagcagctcaacttcggggtcatcaccgacgcgggcctggacgtgtgggggaagggcacgaccctgatcgtgagctccgccagcaccaagggc

SEQ ID NO: 11921 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgccgccgtgaagaagcccggggcgtccgtgaaggtcagctgcgaggcctacggctacaagttcaccgaccacttcatgcactggtggcgccaggccccggggcagggcctcgagtggatggggtggatcaacccctacacctccgccgtgaactacagccccaagtaccagggccgggtgacgatgacccgcgacaccttcctggagaccgtctacatggagctgcggggcctccgcgtggacgacacggccatctactactgcgcgacccccaagtccgggcgggactactggagcttcgacctgtggggccaggggaccctggtgaccgtctccagcgcctccacgaagggc

SEQ ID NO: 11922 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgccgccgtgaagaagcccggggcgtccgtgaaggtcagctgcgagacctacggctacaagttcaccgaccacttcatgcactggtggcgccaggccccggggcagggcctcgagtggatggggtggatcaacccctactccagcgccgtgtcctacagcccccggtaccagggccgcgtgacgatgacccgggacaccttcctggagaccgtctacatggagctgcgcggcctccggttcgacgacacggccatctactactgcgccacccccaagtccgggcgcgactactggagcttcgacctgtggggccaggggaccctggtgaccgtgtccagcgcgtccacgaagggc

SEQ ID NO: 11923 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgccgccgtgaagaagcccggggcgtccgtgaaggtcagctgcgagacctacggctacaccttcacggaccacttcatgcactggtggcgccaggccccggggcagggcctcgagtggatggggtggatcaacccctactccagcgccgtgtcctacagcccccggtaccagggccgcgtgaccatgacccgggacaccttcctggagacggtctacatggagctgcgcggcctcaagttcgacgacaccgccatctactactgcgccacccccaagtccgggcgggactactggagcttcgacctgtggggccaggggaccctggtgacggtgtccagcgcgtccaccaagggc

SEQ ID NO: 11924 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgccgaggtgaagaagcccgggtccagcgtgaaggtctcctgcaagaccagcggcgtgcgcttctccagcaacgccatctcctgggtgcggcaggcgccggggcagggcctcgagtggatggggcgcaccacgcccatgctgggcggcgccaaccacgcccccagcttcaaggggcgggtcaccatctccgccgacgagagcacccgcaccgtgtacatggagatgtccagcctgcggtacgaggacacggccgtgtactactgcgcgtccggccgccgggaggggctcaacttcctgctggactactggggccaggggaccctcgtcaccgtgagctccgccagcaccaagggc

SEQ ID NO: 11925 - RNA, 378 nt, synthetic construct
  misc_feature 1..378: note = derived and/or modified sequence opt1 from anti-HIV_Chain
  source 1..378: mol_type = other RNA
caggtgcagctgcaggagagcggccccgggctcgtcaagccctccgagaccctgagcctgacctgcacggtgtccggcgggagcatctccacctactactggagctggatccgccagccgcccggcaaggggctcgagtggatcggctacatctcctacagcggctccaccaactacaaccccagcctgaagtcccgggtgaccatcagcgtcgacacgtccaagaaccagttcagcctgaagctctccagcgtgaccgccgccgacaccgcggtgtactactgcgcccgccacaagtccgtcctgctgtggttccgggagctcgactactgggggcagggcaccctggtgacggtgagctccgccagcaccaagggg

SEQ ID NO: 11926 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgccgaggtgaagaagcccggggccgcggtgaagatctcctgcaaggccagccgcttcaccttctccagctactacatccactgggtccggcaggccccgggccaggggctcgagtggatgggcatcatcaacccctccgggggcagcacctccaacgcccagaagttccaggaccgcgtgacgctgacccgggacatgagcaccggcaccgtgtacatggagctgtcccgcctcacgagcgaggacaccgccgtctactactgcgcgacccccgagccctccagcatcgtggccccgctgtactactgggggcagggcaccctggtgacggtctccagcgcctccaccaagggg

SEQ ID NO: 11927 - RNA, 378 nt, synthetic construct
  misc_feature 1..378: note = derived and/or modified sequence opt1 from anti-HIV_Chain
  source 1..378: mol_type = other RNA
caggtgcagctggtccagagcggcgccgagatgaagaagcccggggcctccgtgaaggtgagctgcaaggcgtccggccacaccttcaccaactactacatgcactgggtccgccaggccccggggcagggcctcgagtggatggggatgatcaaccccacgggcgacagcacccggtacgcccagcgcttccagggccgggtgaccatgacccgcgacacgtccacccggaccgtgtacatggagctgagctccctgcgcagcgacgacaccgccgtctactactgcgcccgggcgcaccacgacttctggcgcgcccccgtggacgtgtgggggaagggcacgaccgtcaccgtgtccagcgcctccaccaagggg

SEQ ID NO: 11928 - RNA, 378 nt, synthetic construct
  misc_feature 1..378: note = derived and/or modified sequence opt1 from anti-HIV_Chain
  source 1..378: mol_type = other RNA
caggtggtcctgatccagagcggcgccgaggtgaagcgccccgggtccagcgtgaaggtctcctgcaaggccagcggcgggtccttcccgatcacctgggtgcggcaggcgcccggccacgggctcgagtggatgggcggcatcaaccccttcttcgggaccacgaactacgcccagaagttccagggccgcgtgagcatcaccgccgacgagtccaccagcaccacgtacctgcacctgtccgacctccggagcgaggacaccgccgtctacttctgcgcccgcgagaaccgggagaagtggctggtgctgcgctcctggttcgcgccctgggggcagggcaccctcgtgaccgtcagctccgccagcacgaagggg

SEQ ID NO: 11929 - RNA, 378 nt, synthetic construct
  misc_feature 1..378: note = derived and/or modified sequence opt1 from anti-HIV_Chain
  source 1..378: mol_type = other RNA
agccagcagctggtgcagtccggcgcccaggtcaagaagcccggggccagcgtgcgcgtgtcctgccaggcgagcggctacaccttcaccaaccacttcctgcactggtggcggcaggccccgcgccaggggctggagtggatgggctggatcaaccccgtccacgggggccggaactacgcccgccggttccagggccgcatcaacttcgggcgggacgtgtaccaggagacggcctacatggagctgtccggcctccgcaacgacgacaccgccacctacttctgcgcgcgcgggggcggggacggccggaactggcacctccacccctggggccaggggaccctggtgatcgtcagcgccgcctccacgaagggc

SEQ ID NO: 11930 - RNA, 378 nt, synthetic construct
  misc_feature 1..378: note = derived and/or modified sequence opt1 from anti-HIV_Chain
  source 1..378: mol_type = other RNA
gaggtgcaggtcgtggagagcggcgggggcctggtgcagcccgggggctccctccgcctgagctgcgtcgcctccgggttcaccttcagcgagtactggatgtcctgggtgcggcaggccccgggcaagggcctggagtgggtggcgaccatcaagcgcgacgggagcgaggagtcctacgtcgacagcgtgaagggccggttcacgatctcccgcgacaacgccaagaacagcctctacctgcagatgaactccctgcgggccgaggacaccgccgtgtactactgcgcccgcgtccgggaccccaactacaacctccacttcgacagctgggggcagggcaccctggtgaccgtgtccagcgcgtccacgaagggg

SEQ ID NO: 11931 - RNA, 378 nt, synthetic construct
  misc_feature 1..378: note = derived and/or modified sequence opt1 from anti-HIV_Chain
  source 1..378: mol_type = other RNA
ctggtgcagctcgtcgagagcggcgggggcgtggtgcagcccgggaagtccctgcgcctgagctgcgccacctccggcttcaccttcagcacgtacgggatgcactgggtccggcaggccccgggcaagggcctcgagtgggtggcggtgatctggtacgacgggtcctacaagtactacgccgacagcgtcaagggccgcttcaccatctcccgggacaacagcaagaacaccctgttcctgcagatgaactccctccgcgccgaggacaccgccatgtactactgcgggcgggagatggccgtgggcgggacgaaggcgctggaccactggggccagggcaccctggtgaccgtcagctccgccagcaccaagggg

SEQ ID NO: 11932 - RNA, 378 nt, synthetic construct
  misc_feature 1..378: note = derived and/or modified sequence opt1 from anti-HIV_Chain
  source 1..378: mol_type = other RNA
gagttccagctggtgcagagcggcgggggcctcgtcaagcccgggggctccctgcgcctgagctgcaccgggtccaccttcagcttctccagcgacgacatgaactgggtgcggcaggcccccggcaagggcctcgagtgggtgtccagcatgtccgacagcgggtcccacatctactacgccgacttcgtcaagggccgcttcacgatcagccgggacaacgcgaagaagtccctgtacctgcagatgaacagcctccgcgccgaggacaccgccgtgtactactgcgcccagtcccggccgccccagcgcctgtacgggatggacgtgtggggccaggggaccaccgtcacggtgagctccgccagcaccaagggc

SEQ ID NO: 11933 - RNA, 381 nt, synthetic construct
  misc_feature 1..381: note = derived and/or modified sequence opt1 from anti-HIV_Chain
  source 1..381: mol_type = other RNA
gaggtgcagctggtcgagagcggcgggggcgtggtgcagcccgggggctccctccgcctgagctgcgccgcctccgggttcatgttcaagaactacgcgatgcactgggtccggcagccgcccggcaagggcctggagtgggtggccgtgatctggtacgggggccgcgaccagaactacgccgacagcgtcaaggggcggttcaccatctcccgcgacgacagcgacaacaccctctacctgcagatgaactccctgcgggccggcgacacggccgtgtacttctgcgcgcgcaacagccaggtggggcggctcatgcccgccgccggcgtctggggccaggggaccctggtgaccgtgtccagcgcctccaccaagggc

SEQ ID NO: 11934 - RNA, 381 nt, synthetic construct
  misc_feature 1..381: note = derived and/or modified sequence opt1 from anti-HIV_Chain
  source 1..381: mol_type = other RNA
cagggccacctggtgcagagcgggggcggggtcaagaagctcggcacctccgtgaccatcagctgcctggcctccgagtacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgaccagcgcgtccacg

SEQ ID NO: 11935 - RNA, 381 nt, synthetic construct
  misc_feature 1..381: note = derived and/or modified sequence opt1 from anti-HIV_Chain
  source 1..381: mol_type = other RNA
caggtgcagctgctcgagagcggcgggggcctggtccagcgcgggggctccctgcggctcagctgcaccgcctccgggttcgtgttcaacaactactggatgacctgggtgcgccaggcccccggcaacggcctggagtgggtcgcgaacatcgaccaggacgggagcgagaagcactacctggactccgtgaagggccggttcacgatcagccgcgacaacgccaagaactccctctacctgcagatgaacagcctgcgggccgaggacaccgccatctactactgcgcccgcgtgcggttcaaggtcaccgcgtggcaccgcttcgactcctgggggcagggcgacctcgtgaccgtgagctccacgagcaccaagggg

SEQ ID NO: 11936 - RNA, 381 nt, synthetic construct
  misc_feature 1..381: note = derived and/or modified sequence opt1 from anti-HIV_Chain
  source 1..381: mol_type = other RNA
cagagcgccctgacccagcccccgtccgccagcggcacccccgggcagcgcgtgacgatctcctgcagcggctcctaccacaacatcgggagcaacgcggtcaactggtaccagcagctccccggcaccgcccccaagctgctgatctactccaacgaccagcggccgagcggggtgcccgaccgcttctccggcagcaagtccggcaccagcgcctccctcgccatcagcgggctgcagtccgaggacgaggccgactactactgcgcggcctgggacgacagcctgcacgtgttcggcaccgggacgaaggtcaccgtgctcggccagcccaaggccaaccccaccgtgaccctgttcccgccctccagcgaggagctg

SEQ ID NO: 11937 - RNA, 381 nt, synthetic construct
  misc_feature 1..381: note = derived and/or modified sequence opt1 from anti-HIV_Chain
  source 1..381: mol_type = other RNA
cagagcgtgctgacccaggtcctctccgtgagcggcacccccgggcagcgcgtgatcatctcctgcagcggcacgtccagcaacgtcgggggcaacctggtgtcctggtaccagcacctcccgggggccgcgccccggctgctgatccaccgcgacgaccagcggcccagcggcgtgcccgaccgcttctccggcagcaagtccgggaacagcgcctccctggtcatcagcggcctccggtccgacgacgaggccgactacttctgcgccgcctacgacagcaccttctccctgccggtgttcgggggcgggacccgcctgaccgtgctcagccagcccaaggccgcgccctccgtcacgctgttcccgcccagcagcgag

SEQ ID NO: 11938 - RNA, 381 nt, synthetic construct
  misc_feature 1..381: note = derived and/or modified sequence opt1 from anti-HIV_Chain
  source 1..381: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccctgccagttccagggccgggtgagcctgacgcgccacgcctcctgggacttcgacaccttcagcttctacatggacctcaaggccctgcggtccgacgacaccgcggtgtacttctgcgcccgccagcggagcgactactgggacttcgacgtctgggggtccggcacccaggtgacggtgagctccgccagcaccaag

SEQ ID NO: 11939 - RNA, 381 nt, synthetic construct
  misc_feature 1..381: note = derived and/or modified sequence opt1 from anti-HIV_Chain
  source 1..381: mol_type = other RNA
caggtgcagctggtccagagcggcggggaggtgcgcaagcccggctccagcgtgaaggtcccgtgcaagatctccgggaacgccttcagcaactacggcgtgaactgggtgcggcaggcccccgggcagggcctcgagtgggtcggccgcatcatccccgtgatcggggtggcgcagcacgcccccaagttccagggccgggtcaccatcaccgccgacaagtccacgaccaccgcctacctggagctgagctccctccgcagcgacgacaccgccgtgtacttctgcgcgaaggaccacggggacccgcggacgggctactacttcgactactgggggcagggcgccctggtgaccgtctccagcgcctccaccaagggc

SEQ ID NO: 11940 - RNA, 381 nt, synthetic construct
  misc_feature 1..381: note = derived and/or modified sequence opt1 from anti-HIV_Chain
  source 1..381: mol_type = other RNA
caggtgcagctgggccagagcgggaccgaggtcaagaagcccggcttctccgtgaaggtgagctgcaaggcctccgggggcagctccaccgcctacgggtacagctgggtccgccaggcgccgggccagggcttcgagtggatggggcggatcatccccttctacggcatcatcacgtacgcccccaagttccaggggcgcgtgaccatcaccgccgaccggtccaccagcacggtgtacatggagctcacctccctgaccttcgccgacaccgccctgttcttctgcgcgcgcgacttcggcgacccccggaacgggtactacttcgacagctgggaccagggcctctggctgacggtctccagcgcctccaccaagggc

SEQ ID NO: 11941 - RNA, 381 nt, synthetic construct
  misc_feature 1..381: note = derived and/or modified sequence opt1 from anti-HIV_Chain
  source 1..381: mol_type = other RNA
caggtgcagctggtccagagcggcgccgaggtgaagaagcccgggtccagcgtgaaggtctcctgcaaggccagcggcgggaccttctccaactacgcgatcagctgggtgcgccaggccccgggccaggggctcgagtggatgggcggcatcatccccatcttcgaggccgcctcctacgcccagaagttccaggaccggctgaccatcacgaccgacgagagcaccaccacggcgtacatggacctgtccagcctccgctccgaggacaccgccatctactactgcgcccgggcccagggggacatcctgaccgagggctacttcgactactgggggcagggcaccctggtgacggtcagctccgcgagcaccaagggg

SEQ ID NO: 11942 - RNA, 381 nt, synthetic construct
  misc_feature 1..381: note = derived and/or modified sequence opt1 from anti-HIV_Chain
  source 1..381: mol_type = other RNA
caggtgcagctgcaggagagcggccccgggctcgtcaagccgtccgagaccctgagcctgacctgcacggtgtccggcgggagcatctccagcgccggctactactggtcctggatccgccagcaccccgagaaggggctcgagttcatcggctacatctactacctgggcaccacctactacaaccccagcctgaagtcccgggtgagcatctccatcgacaccagcaacaaccagttctccctcgagctgagctccgtcagcgccgcggacacggccatctactactgcgcccgcgactacaccgcctccgggcggcacttcttcgactactggggccaggggaccctggtgaccgtgagctccgccagcacgaagggc

SEQ ID NO: 11943 - RNA, 381 nt, synthetic construct
  misc_feature 1..381: note = derived and/or modified sequence opt1 from anti-HIV_Chain
  source 1..381: mol_type = other RNA
caggtgcagctggtccagagcggcgccgaggtgaagaagcccggggcctccgtgaaggtcagctgcaaggcgccgggctacaccttcatcgggcactacatgcactggatccgccaggcccccggccaggggctcgagtggatgggctggatcaaccccaactccggcgacaccaactacgcccagacgttccaggggcgggtgaccatgacccgcgacaccagcatctccacggcctacatggagctgacccggctgcgcagcgacgacaccgccgtgtactactgcgcgcgggacctccgccccatgcggggcaactgggccatgcacgtctggggcgaggggaccacggtgaccgtgtccagcgcctccaccaagggg

SEQ ID NO: 11944 - RNA, 381 nt, synthetic construct
  misc_feature 1..381: note = derived and/or modified sequence opt1 from anti-HIV_Chain
  source 1..381: mol_type = other RNA
caggtgcagctgcaggagagcggccccgggctcgtcaagccgtccgagaccctgagcctgacctgcacggtgttcggcgcctccatccgcagcttctactggcactggatccggcagtcccccgggaagggcctcgagtggctggggagcgtgttcgacaacggcctgaccacctacaacccctccctcaagaaccgcctgagcatctccgaggaccccagccggaaccagatctccctgaacctccgcagcatgaccgccgcggacacggccgtctactactgcgcccgggccgactacgacctgctgacctccagctaccacttcgactcctggggccaggggaccctcgtgaccgtgagctccgccagcacgaagggc

SEQ ID NO: 11945 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcgtgtcctgccaggccagcggctacaccttcacggactacgtcctgcactggtggcggcaggcgccggggcagggcctggagtggatggggtggatcaagcccgtgtacggcgcccgcaactacgcccaccggttccagggccgcatcaacttcgaccgggacgtgtaccgcgagatcgcctacatggacctgtccgggctccggagcgacgacaccgccgtctacttctgcgcgcgcgacggctccggggacgccaccagctggcacctccacccctggggccaggggaccctggtgatcgtgtccagcgcctccacgaagggc

SEQ ID NO: 11946 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcgtgtcctgccaggccagcggctacaccttcacgaactacatcctccactggtggcggcaggcgccggggcgcggcctggagtggatggggctgatcaagcccgtctacggcgccgtgaactacgcccggcagttccagggccgcatccagctcacccgggacatctaccgcgagatcgccttcctggacctgtccgggctccggcccgacgacaccgccgtgtactactgcgcgcgcgacgagagcggctacgacctgaactggcacctggactcctgggggcagggcacccaggtcatcgtgagccccgcctccacgaagggg

SEQ ID NO: 11947 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcgcccaggtcaagaagcccggggccagcctccgcgtgtcctgccaggcgagcggctacaccttcatgaactacctgctgcactggtggcggcaggccccggggcagggcctcgagtggatggggtggatcaaccccgtgtacggcgccgtcaactacgcccaccgcttccagggccggctgaccttctcccgcgacgtgtaccgggagatcgcctacatggacctgaacgggctccgcagcgacgacacggcggtgtacttctgcgcccgggacggctccggggacgaccgcaactggcacctggacccctggggccaggggaccctggtcatcgtgagctccgccagcaccaagggc

SEQ ID NO: 11948 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcatctcctgccaggccagcggctacaccttcacggactacgtgctccactggtggcggcaggcgccggggcagggcctggagtggatggggtggatcaagcccgtctacggcgcccgcaactacgcccggcgcttccagggccggatcaacttcgaccgcgacatctaccgggagatcgccttcctggacctctccgggctgcgcagcgacgacaccgcccggtacttctgcgcgcgcgacggctccggggacgacaccagctggcacctccacccctggggccaggggaccctggtgatcgtgtccgccgccagcacgaagggc

SEQ ID NO: 11949 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagaccggggccagcgtgcgcgtgtcctgccaggccagcggctacgacttcacgaagtacctcatccactggtggcggcaggcgcccgggcagggcctggagtggatggggtggatgaagccggtctacggcgccaccaactacgcccaccgcttccagggccggatctccttcacccgcgacatctaccgggagatcgccttcatggacctgaacgggctccgcagcgacgacaccgccgtgtacttctgcgcgcgggacggcgggggcgacgaccgcacgtggctgctggacgcctgggggcagggcaccctcgtgatcgtctccagcgcctccaccaagggc

SEQ ID NO: 11950 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcgtgtcctgccaggccagcggctacaccttcatgaactacatcatccactggtggcggcaggcgccggggcagcgcctcgagtggatgggctggatcaaccccgtcttcggggcccggaactacgcccaccgcttccagggccggatcaacttcgaccgcgacatcaaccgggagacgttccagatggacctgaccggcctgcgctccgacgacaccgccgtgtactactgcgcccgggacgggagcggcgacgcgcgcgactggcacctccacccctgggggcagggcaccctggtgatcgtctccagcgcctccacgaagggg

SEQ ID NO: 11951 - RNA, 381 nt, synthetic construct
  misc_feature 1..381: note = derived and/or modified sequence opt1 from anti-HIV_Chain
  source 1..381: mol_type = other RNA
agccagcacctggtgcagtccggcacccaggtcaagaagcccggggccagcgtgcgcgtgtcctgccaggccagcggctacaccttcacgaactacatcctgcactggtggcggcaggcgccggggcagggcctggagtggatggggctgatcaagcccgtcttcggcgccgtgaactacgcccgccagttccagggccggatccagctcacccgcgacatcaaccgggagatcgccttcctggacctgtccgggctccgcagcgacgacaccgccgtgtactactgcgcgcgggacgagtccggcgacgacctgaagtggcacctccacccctgggggcagggcacccaggtcatcgtgagccccgcctccacgaagggg

SEQ ID NO: 11952 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcgtgtcctgccaggccagcggctacaccttcatgaactacatcatccactggtggcggcaggcgccggggcagcgcctcgagtggatgggctggatcaaccccgtcttcggggcccggaactacgcccaccgcttccagggccggatcaacttcgaccgcgacatcaaccgggagacgttccagatggagctgaccggcctgcgctccgacgacaccgccgtgtactactgcgcccgggacgggagcggcgacgcgcgcgactggcacctcgacccctgggggcagggcaccctggtgatcgtctccagcgcctccacgaagggg

SEQ ID NO: 11953 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcatctcctgccaggccagcggctacaccttcacggactacgtgctgcactggtggcggcaggcgccggggcagggcctggagtggatggggtggatcaagcccgtctacggcgcccgcaactacgcccggcgcttccagggccggatcaacttcgaccgcgacatctaccgggagatcgcctacatggacctgtccgggctccgcagcgacgacaccgcccggtacttctgcgcgcgcgacggctccggggacgacaccagctggcacctccacccctggggccaggggaccctggtgatcgtgtccgccgccagcacgaagggc

SEQ ID NO: 11954 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcatctcctgccaggccagcggctactccttcaccgactacgtgctccactggtaccggcaggcgccggggcagggcctggagtggatggggtggatcaagcccgtctacggcgcccgcaactacgcccggcgcttccagggccggatcaacttcgaccgcgacatctaccgggagatcgccttcatggacctgagcgggctccgctccgacgacacggccctgtacttctgcgcgcgggacggcagcggggacgacacctcctggtacctggacccctggggccaggggaccctcgtgatcgtgagcgccgcctccaccaagggc

SEQ ID NO: 11955 - RNA, 381 nt, synthetic construct
  misc_feature 1..381: note = derived and/or modified sequence opt1 from anti-HIV_Chain
  source 1..381: mol_type = other RNA
agccagcagctggtgcagtccggcacccaggtcaagaagcccggggccagcgtgcgcatctcctgccaggccagcggctactccttcaccgactacgtgctccactggtggcggcaggcgccggggcagggcctggagtggatggggtggatcaagcccgtctacggcgcccgcaactacgcccggcgcttccagggccggatcaacttcgaccgcgacatctaccgggagatcgccttcatggacctgagcgggctccgctccgacgacacggccctgtacttctgcgcgcgggacggcagcggggacgacacctcctggcacctggacccctggggccaggggaccctcgtgatcgtgagcgccgcctccaccaagggc

SEQ ID NO: 11956 - RNA, 381 nt, synthetic construct
  misc_feature 1..381: note = derived and/or modified sequence opt1 from anti-HIV_Chain
  source 1..381: mol_type = other RNA
agccagcacctggtgcagtccggcacccaggtcaagaagcccggggccagcgtgcgcgtgtcctgccaggccagcggctacaccttcacgaactacatcctgcactggtggcggcaggcgccggggcagggcctggagtggatggggctgatcaagcccgtcttcggcgccgtgaactacgcccgccagttccagggccggatccagctcacccgcgacatctaccgggagatcgccttcctggacctgtccgggctccgcagcgacgacaccgccgtgtactactgcgcgcgggacgagtccggcgacgacctgaagtggcacctccacccctgggggcagggcacccaggtcatcgtgagccccgcctccacgaagggg

SEQ ID NO: 11957 - RNA, 381 nt, synthetic construct
  misc_feature 1..381: note = derived and/or modified sequence opt1 from anti-HIV_Chain
  source 1..381: mol_type = other RNA
caggtgcagctggtcgagagcggcgggggcgtggtgcagcccgggaagtccctccgcctgagctgcgccatctccggcttcctgttcaacaactacgggggccagtgggtccggcaggcccccggcaaggggctcgagtgggtggcggccatcagctacgacggcaacaaccgctactacgccgactccgccaaggggcggttcctgatcagccgcgacacccccaagaacatcctgtacctccagatctactccctgcggctggacgacaccgccgtgtactactgcgcgcgcgacagcgtctccaagagctactccgccccgcccgagttctggggccaggggacggtggtgaccgtcagctccgccagcaccaagggc

SEQ ID NO: 11958 - RNA, 381 nt, synthetic construct
  misc_feature 1..381: note = derived and/or modified sequence opt1 from anti-HIV_Chain
  source 1..381: mol_type = other RNA
caggtgcacctggaggagagcggccccgggctcgtcaagacctcccagaccctgagcctgacgtgctccgtgagctcctacagcatctcccgcagcggctacttctggacctggatccggcagcgcccggggaagggcctcgagtggatcgggtacatctacttcaacggccggaccacctacaacccctccctcaagagccgcatcacgatctcccgggacaccagccactcccagttcagcctgaccctgaactccctgagcgccgccgacaccgcggtgtactactgcggccgctgccaggacgggctggcctcccggcccatcgacttctggggccaggggacgctcgtcaccgtgagctccgccagcaccaagggc

SEQ ID NO: 11959 - RNA, 381 nt, synthetic construct
  misc_feature 1..381: note = derived and/or modified sequence opt1 from anti-HIV_Chain
  source 1..381: mol_type = other RNA
caggtgcagctggtcgagagcggcgggggcgtggtgcagcccgggcgctccctccggctgagctgcgccacctccggcttcaccagcaagaactacggggtccactgggtgcgccaggccccgggcaagggcctggagtgggtggcggtcatctggtacgacgggtccaacaagttctacgccgacagcgtgaagggccggttcacgatctcccgcgaccggagcaagaacatggtgtacctccagatgaactccctgcgcgtcgaggacaccgccatctactactgcgcccgggacagcgtggccttcgtgctggaggggcccatcgactactggggccaggggaccctcgtcaccgtgtccagcgcgtccacgaagggc

SEQ ID NO: 11960 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgggggcgtgaagaagcccgggacctccgccagcttctcctgccgcaccagcgacgacatctacgacaacgagttcttcgactccgccttcatgcactgggtgcggctcatcccgggccagcgccccgagtggatggggtggatgaacccccggagcggcgcggtcaactacgcccgccagctgcagccccgggtgtccatgtaccgcgaccgggacctgagcacggcctacatggagttcaagtccctcaccagcgccgacaccggcacctacttctgcgcccgcaagaagcgcggggacggcttcaacctgtacttcgacctgtgggggcggggctcccaggtgatcgtcagctccgcg

SEQ ID NO: 11961 - RNA, 384 nt, synthetic construct
  misc_feature 1..384: note = derived and/or modified sequence opt1 from anti-HIV_Chain
  source 1..384: mol_type = other RNA
cagggccacctggtgcagagcgggggcggggtcaagaagctcggcacctccgtgaccatcagctgcctggcctccgaggacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgaccagcgcgtccacgagc

SEQ ID NO: 11962 - RNA, 384 nt, synthetic construct
  misc_feature 1..384: note = derived and/or modified sequence opt1 from anti-HIV_Chain
  source 1..384: mol_type = other RNA
cagagcgccctgacccagcccccgtccgtgagcggcgcccccgggcagcgcgtcaccatctcctgcagcggcgggccctccaacgtgggcgggaactacgtgtactggtaccggcagttccccggcacggcgcccaagctcctgatcctgcgcgacgaccagcggcccagcggcgtccccgaccgcttctccgccagcaagtccgggaacagcgcctccctcgccatcagcggcctgcggcccgacgacgaggccttctacttctgcgcgacctacgactcccaggggagcttccgcgtgttcggcgggggcaccgccctgaccgtgctctcccagccgaaggccgcccccagcgtcacgctgtacccgccctccagcgaggag

SEQ ID NO: 11963 - RNA, 384 nt, synthetic construct
  misc_feature 1..384: note = derived and/or modified sequence opt1 from anti-HIV_Chain
  source 1..384: mol_type = other RNA
aacttcatgctgacccagcccccgagcgcctccggcacccccgggcagcgcgtgacgatcagctgctccggcgggggcagcaacatcgggggcaacctcgtctcctggtaccagcacttccccggcgccgcgcccaagctgctgatctaccggaacgaccagcgcccgagcggggtgcccgaccggttctccggcagcaagtccgggaccagcgcctccctcgccatcagcggcctgcgctccgacgacaaggccacctacttctgcgccgcgtacgacagcaccctgtccctccggctgttcgggggcggcacgaccctgaccgtgctcagccagcccaaggccgccccctccgtcaccctgttcccgcccagctccgaggag

SEQ ID NO: 11964 - RNA, 384 nt, synthetic construct
  misc_feature 1..384: note = derived and/or modified sequence opt1 from anti-HIV_Chain
  source 1..384: mol_type = other RNA
aacttcatgctgacccagcccccgagcgtgtccgccacccccggccagacggtcaccatcagctgctccgggagcggctccaacgtcgggggcaaccacgtgtactggtaccgccagctccccggggccgcgcccaccctggtgatcagcaagaccgaccaccggccctcccgcgtgcccgaccggttcagcggctccaagagcggcaactccgccagcctggccatctccgggctccgccccgacgacgaggccgtgtacttctgcgccacgtacgacaccggcctgagcctgcgcctcttcgggggcgggacccggctgaccgtcctgtcccagcccaaggcggccccgagcgtgacgcagttcccgccctccagcgaggag

SEQ ID NO: 11965 - RNA, 384 nt, synthetic construct
  misc_feature 1..384: note = derived and/or modified sequence opt1 from anti-HIV_Chain
  source 1..384: mol_type = other RNA
cagagcgccctgacgcagccgccctccgccagcggcgcgcccgggcagcgcgtgaccatctcctgcagcggcgggccctccaacgtcggcgggaactacgtgtactggtaccggcagttccccggcacggcccccaagctcctgatcctgcgcgacgaccagcggcccagcggcgtgcccgaccgcttctccgccagcaagtccgggaacagcgcctccctcgccatcagcggcctgcggcccgacgacgaggcgctgtacttctgcgccacctacgactccgacgggagcatccgcctcttcggcgggggcaccgccctgaccgtcctgtcccagccgaaggccgcgcccagcgtgaccctcttcccgcccggctgggaggag

SEQ ID NO: 11966 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggctgttccagggccgcgtgagcctcacgcggcacgcctcctgggacttcgacaccttcagcttctacatggacctgaaggccgtgcgctccgacgacaccgcggtctacttctgcgcccggcagcgcagcgactactgggacttcgacgtgtgggggtccggcacccaggtgacggtcagctccgccagcaccaagggg

SEQ ID NO: 11967 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgtcgtgaccaagcccggggcctccgtgcgcgtcagctgcgaggcgtccggctacaagatccgggactacttcatccactggtggcgccaggccccggggcagggcctgcagtgggtggggtggatcaacccccagaccggccagcccaacatcccccggccgttccagggccgcgtgacgctgacccggcacgccagctgggacttcgacaccttctccttctacatggacctcaaggccctgcgcagcgacgacaccgccatctacttctgcgcgcggcgccggtccgactactgcgacttcgacgtctgggggagcggcacgcacgtgaccgtgtccagcgcctccaccaagggg

SEQ ID NO: 11968 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcaggcctcctgggacttcgacaccatcagcttctacatggacctcaaggccctgcgcctggacgacaccgcggtgtacttctgcgcccggcagcgctccgactactgggacttcgacgtctgggggagcggcacccaggtgacggtgtccagcgcctccaccaagggg

SEQ ID NO: 11969 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggccctgcgctccgacgacaccgcggtgtacttctgcgcccggcagcgcagcgactactgggacttcgacgtctgggggtccggcacccaggtgacggtgtacagcgcctccaccaagggg

SEQ ID NO: 11970 - RNA, 384 nt, synthetic construct
  misc_feature 1..384: note = derived and/or modified sequence opt1 from anti-HIV_Chain
  source 1..384: mol_type = other RNA
caggtgcagctgctccccttcggcggggccgtcaccaagccgggcgccagcgtgcgcgtgtcctgcgaggcgagcgggtacaacatccgggactacttcatccactggtggcgccaggcccccggccaggggctgcagtgggtcggctggatcaaccccaagaccggccagcccaacaacccgtgccagttccaggggcgggtgtccctgacgcgccccgccagctgggacttcgacaccatctccttctacatggacctcaaggccctgcggctggacgacaccgccgtgtacttctgcgcgcgccagcggagcgactactgggacttcgacgtctggggctccgggacccaggtgacggtgagctccgccagcaccaagggc

SEQ ID NO: 11971 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccgggtgagcctgacgcgccaggcctcctgggacttcgacacctacagcttctacatggacctgaaggccctccggtccgacgacaccgcgatctacttctgcgcccgccagcggagcgacttctgggacttcgacgtgtgggggtccggcacccaggtcacggtgagctccgccagcaccaagggg

SEQ ID NO: 11972 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccgggtgagcctgacgcgccaggcctcctgggacttcgacacctacagcttctacatggacctgaaggccgtgcggtccgacgacaccgcgatctacttctgcgcccgccagcggagcgacttctgggacttcgacgtctgggggtccggcacccaggtgacggtgagctccgccagcaccaagggg

SEQ ID NO: 11973 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaagatcagcgaccacttcatccactggtggcggcaggccccggggcagggcctgcagtgggtcgggtggatcaaccccaagaccggccagcccaacaacccccgccagttccagggccggatctccctgacgcgccaggccagctgggacttcgacaccttctccttctacatggacctcaaggccctgcggagcgacgacaccgcggtgtacttctgcgcccgccagcggtccgactactgggacttcgacgtgtgggggagcggcacccaggtcacggtgtccagcgcctccaccaagggg

SEQ ID NO: 11974 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggggctgcgctccgacgacaccgccatctacttctgcgcgcggcagcgcagcgactactgggacttcgacgtgtggggctccgggacccaggtcacggtgagctccgccagcaccaagggc

SEQ ID NO: 11975 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggccctgcgctccgacgacaccgcggtgtacttctgcgcccggcagcgcagcgactactgggacttcgacgtctgggggtccggcacccaggtgacggtgagctccgccagcaccaagggg

SEQ ID NO: 11976 - RNA, 384 nt, synthetic construct
  misc_feature 1..384: note = derived and/or modified sequence opt1 from anti-HIV_Chain
  source 1..384: mol_type = other RNA
cacgtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcaggcctcctgggacttcgacaccttcagcttctacatggacctcaaggccctgcgcctggacgacaccgcgatctacttctgcgcccggcagcgctccgactactgggacttcgacgtgtgggggagcggcacccaggtcacggtgtccagcgcctccaccaagggg

SEQ ID NO: 11977 - RNA, 384 nt, synthetic construct
  misc_feature 1..384: note = derived and/or modified sequence opt1 from anti-HIV_Chain
  source 1..384: mol_type = other RNA
caggtgcacctgagccactccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccggatcagcctgacgcgccaggcctcctgggacttcgacaccttcagcttctacatggacctgaaggccctccggtccgacgacaccgcggtgtacttctgcgcccgccagcggagcgactactgggacttcgacgtgtgggggtccggcacccaggtcacggtgagctccgccagcaccaagggg

SEQ ID NO: 11978 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgaccacttcatccactggtggcggcaggccccggggcagggcctccagtgggtggggtggatcaaccccaagaccggccagcccaacaacccccgccagttccagggccggatcagcctgacgcgccaggcctcctgggacttcgacaccttcagcttctacatggacctgaaggccctccggtccgacgacaccgccgtgtacttctgcgcgcgccagcggagcgactactgggacttcgacgtctgggggtccggcacccaggtgacggtgagctccgccagcaccaagggg

SEQ ID NO: 11979 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgaccacttcatccactggtggcggcaggccccggggcagggcctccagtgggtggggtggatcaaccccaagaccggccagcccaacaacccccgccagttccagggccggatcagcctgacgcgccaggcctcctgggacatcgacaccttcagcttctacatggacctgaaggccctccggtccgacgacaccgccgtgtacttctgcgcgcgccaccggagcgactactgggacttcgacgtctgggggtccggcacccaggtgacggtgagctccgccagcaccaagggg

SEQ ID NO: 11980 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgaccacttcatccactggtggcggcaggccccggggcagggcctccagtgggtggggtggatcaaccccaagaccggccagcccaacatcccccgccagttccagggccggatcagcctgacgcgccaggcctccggggacttcgacaccttcagcttctacatggacctgaaggccctccggtccgacgacaccgccgtgtacttctgcgcgcgccagcggagcgactactgggacttcggcgtctgggggtccggcacccaggtgacggtgagctccgccagcaccaagggg

SEQ ID NO: 11981 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgggcacttcatccactggtggcggcaggccccgggccaggggctccagtgggtgggctggatcaaccccaagaccggccagcccaacaacccccgccagttccaggggcggatcagcctgacgcgccaggcctcctgggacttcgacaccttcagcttctacatggacctgaaggccctccggtccgacgacaccgccgtgtacttctgcgcgcgccaccggagcgactactgggacttcgacgtctggggctccgggacccaggtgacggtgagctccgccagcaccaagggc

SEQ ID NO: 11982 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccggatcagcctgacgcgccaggcctcctgggacttcgacaccttcagcttctacatggacctgaaggccctccggtccgacgacaccgcggtgtacttctgcgcccgccaccggagcgactactgggacttcgacgtgtgggggtccggcacccaggtcacggtgagctccgccagcaccaagggg

SEQ ID NO: 11983 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccgggtgagcctgacgcgccaggcctcctgggacttcgacacctacagcttctacatggggctgaaggccgtgcggtccgacgacaccgcgatctacttctgcgcccgccagcggagcgacttctgggacttcgacgtctggggctccgggacccaggtgacggtgagctccgccagcaccaagggc

SEQ ID NO: 11984 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgaccacttcatccactggtggcggcaggccccggggcagggcctccagtgggtggggtggatcaaccccaagaccggccagcccaacaacccccgccagttccagggccggatcagcctgacgcgccaggcctcctgggacttcgacaccttcagcttctacatggacctgaaggccctccggtccgacgacaccgccgtgtacttctgcgcgcgccaccggagcgactactgggacttcgacgtctgggggtccggcacccaggtgacggtgagctccgccagcaccaagggg

SEQ ID NO: 11985 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgaccacttcatccactggtggcggcaggccccggggcagggcctccagtgggtggggtggatcaaccccaagaccggccagcccaacaacccccgccagttccagggccggatcagcctgacgcgccaggcctcctgggacttcgacaccttcagcttctacatggacctggaggccctccggtccgacgacaccgccgtgtacttctgcgcgcgccagcggagcgactactgggacttcgacgtctgggggtccggcacccaggtgacggtgagctccgccagcaccaagggg

SEQ ID NO: 11986 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgccgtcaccaagcccggggcgagcgtgcgcgtgtcctgcgaggccagcggctacaagatccgggactactccatccactggtggcgccaggccccggggcagggcctccagtgggtcgggtggatcaacccccagaccggccagcccaacatcccccggccgttccagggccgcatcagcctgacgcggcaggcctcctgggacttcgacaccttcagcttctacatggacctggaggccctccgctccgacgacaccgcggtgtacttctgcgcccggcagcgcagcgactactgggacttcgacgtgtgggggtccggcacccaggtcacggtgagctccgccagcaccaagggg

SEQ ID NO: 11987 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccggatcagcctgacgcgccaggcctcctgggacttcgacaccttcagcttctacatggacctgaaggccctccggtccgacgacaccgcggtgtacttctgcgcccgccagcggagcgactaccgcgacttcgacgtgtgggggtccggcacccaggtcacggtgagctccgccagcaccaagggg

SEQ ID NO: 11988 - RNA, 384 nt, synthetic construct
  misc_feature 1..384: note = derived and/or modified sequence opt1 from anti-HIV_Chain
  source 1..384: mol_type = other RNA
caggtgcacctgagccagtccggcgccgtcgtgaccaagcccggggccagcgtgcgcgtctcctgcgaggcgagcggctacaagatctccgaccacttcatccactggtggcggcaggccccggggcagggcccccagtgggtggggtggatcaaccccaagaccggccagcccaacaacccgcgccagttccagggccggatcagcctcacgcgccaggcctcctgggacttcgacaccttcagcttctacatggacctgaaggccctgcggtccgacgacaccgccgtgtacttctgcgcgcgccaccggagcgactactgggacttcgacgtctgggggtccggcacccaggtgacggtgagctccgccagcaccaagggg

SEQ ID NO: 11989 - RNA, 384 nt, synthetic construct
  misc_feature 1..384: note = derived and/or modified sequence opt1 from anti-HIV_Chain
  source 1..384: mol_type = other RNA
caggtgcgcctgctccagagcggcgccgccgtcaccaagcccggggcgtccgtgcgggtgagctgcgaggcctccggctacgagatccgcgactacttcatccactggtggcggcaggccccggggcagggcctgcagtgggtcgggtggatcaaccccaagaccggccagcccaacaacccccgccagttccagggccgggtgagcctgacgcgccaggcctcctgggacttcgacagctactccttctacatggacctcaaggccctgcggagcgacgacaccgcggtgtacttctgcgcccgccagcggtccgactactgggacttcgacgtctgggggagcggcacccaggtgaccgtgtccagcgcctccacgaagggg

SEQ ID NO: 11990 - RNA, 384 nt, synthetic construct
  misc_feature 1..384: note = derived and/or modified sequence opt1 from anti-HIV_Chain
  source 1..384: mol_type = other RNA
caggtgcgcctgctccagagcggcgccgccgtcaccaagcccggggcgtccgtgcgggtgagctgcgaggcctccggctacgagatccgcgactacttcatccactggtggcggcaggccccggggcagggcctgcagtgggtcgggtggatcaaccccaagaccggccagcccaacaacccccgccagttccagggccgggtgagcctgacgcgccaggcctcctgggacttcgacagctactccttctacatggacctcaaggccctgcggagcgacgacaccggggtgtacttctgcgcgcgccagcggtccgactactgggacttcgacgtctggggcagcgggacccaggtgaccgtgtccagcgcctccacgaagggc

SEQ ID NO: 11991 - RNA, 384 nt, synthetic construct
  misc_feature 1..384: note = derived and/or modified sequence opt1 from anti-HIV_Chain
  source 1..384: mol_type = other RNA
caggtgcgcctgctccagagcggcgccgccgtcaccaagcccggggcgtccgtgcgggtgagctgcgaggcctccggctacgagatccgcgactacttcatccactggtggcggcaggccccggggcagggcctgcagtgggtcgggtggatcaaccccaagaccggccagcccaacaacccccgccagttccagggccgggtgagcctgacgcgccaggcctcctgggacttcgacagctactccttctacatggacctcaaggccctgcggagcgacgacaccgcggtgtacttctgcgcccgccagcggtccgactactgggacttcgacgtctgggggagcggctcccaggtgaccgtgagctccgccagcaccaagggg

SEQ ID NO: 11992 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccctgccagttccagggccgggtgagcctgacgcgccaggcctcctgggacttcgacaccatcagcttctacatggacctcaaggccctgcggctggacgacaccgcggtgtacttctgcgcccgccagcggtccgactactgggacttcgacgtctgggggagcggcacccaggtgacggtgtccagcgcctccaccaagggg

SEQ ID NO: 11993 - RNA, 384 nt, synthetic construct
  misc_feature 1..384: note = derived and/or modified sequence opt1 from anti-HIV_Chain
  source 1..384: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggccctgcgctccgacgacaccgcggtgtacttctgcgcccggcagcgcagcgactactgggacttcgacgtctgggggtccggcacccaggtgatcgtgagctccgccagcacgaagggg

SEQ ID NO: 11994 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgacgtgaagaagcccggggccaccgtgaccgtctcctgcaagacggacgaggacgaggacgacttccgcgcgcacctcatgcagtggatgcggcaggccccgggccagcgcctggagtgggtggggtggatcaagccccagaccggccagcccagctacgggcagaagttccagggccgggtgaccctgacccgcgaggtctccacgagcaccgtgttcctccagctgcggaacctgcgctccgacgacaccgccgtgtactactgcgcccggccccgcggcgggcgggacaactggagcttccacgtctggggccgcgggaccctcgtgacggtgtccagcgcctccaccaagggc

SEQ ID NO: 11995 - RNA, 384 nt, synthetic construct
  misc_feature 1..384: note = derived and/or modified sequence opt1 from anti-HIV_Chain
  source 1..384: mol_type = other RNA
gaggtgcagctggtcgagagcggcgccgaggtgaagaagcccggggcctccgtgaaggtcagctgcaaggtgtccggcaacagcctcaccgagttctccatccactgggtgcgccaggcgccggggaagggcctggagtggatgggcgggttcgaccccgaggagggcgagaccgtccccgcccagaagttcaaggggcggctgacgatgaccgaggacaccagcaccaacacggcctacatggagctctccagcctgcgctccgaggacaccgccgtgtactactgcagcaccgagccccgggagatgggcaccctgacggccgggttcgagtactggggccaggggaccctcgtgaccgtctccagcgcgtccaccaagggc

SEQ ID NO: 11996 - RNA, 384 nt, synthetic construct
  misc_feature 1..384: note = derived and/or modified sequence opt1 from anti-HIV_Chain
  source 1..384: mol_type = other RNA
cgcgtgcagctgggccagagcggggccgaggtcaagaagcccggcgcctccgtgaaggtgagctgcaaggtctccgggaacagcctcaccgagttctccatccactgggtgcggcaggcgccgggcaaggggctggagtggatgggcggcttcgaccccgaggagggggagaccgtgcccgcccagaagttcaagggccgcgtcacgatgaccgaggacaccagcaccaacacggcctacatggagctgtccagcctccggtccgaggacaccgccgtgtactactgcagcaccgagccccgcgagatggggaccctgacggccggcttcgagtactgggggcagggcaccctggtgatcgtctccagcgcgtccaccaagggc

SEQ ID NO: 11997 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgacgtgaagaagcccggggcctccgtgaccgtcagctgcaagaccgacgaggacgaggacgacttccgcgcgcacctcgtgcagtggatgcggcaggccccgggccagcgcctggagtgggtggggtggatcaagccccagacgggccagccctcctacgcccagaagttccaggggcgggtcaccctgacccgcgaggtgagcacctccacggtgttcctccagctgcggaacctgcgcagcgacgacaccgccgtctactactgcgcccggccccgcggcggccgggacaactggtccttccacgtgtgggggcgcggcaccctcgtgaccgtcagctccgcgagcacgaagggg

SEQ ID NO: 11998 - RNA, 384 nt, synthetic construct
  misc_feature 1..384: note = derived and/or modified sequence opt1 from anti-HIV_Chain
  source 1..384: mol_type = other RNA
caggtgcagctgcaggagagcggccccgggctcgtcaagccgtccgagaccctgagcctgacctgctccgtgagcggcgcctccatcagcaacttctactggacgtggatccgccagcccgccgggaagggcctcgagtgggtggggcggctgtactccagcgaccgcaccaactacaacccctccctgaacggccgggtcaccatgagcctcgacacctccaagaaccagttcagcctgcgcctgacgtccatgaccgacgcggacaccgccatctacttctgcgcccgggagaagggccagtggctcaccgtgcccccgtactacttcgacagctgggggcagggcatcctggtgacggtctccagcgcctccaccaagggg

SEQ ID NO: 11999 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgcgcaagcccggggcctccgtgaaggtcagctgcaagacctccggctacaccttcacgaacagctacatccactgggtgcggcaggcgccggggcagggcctcgagtggatggggatcatcaacccgcccggcggcaacacctactacgcccagaagttccacgggcgcgtgaccctgacccgggacacgtccaccagcaccgtctacatggagctgaactccctccgcagcgaggacaccgccgtgtacttctgcgcccggccccactcccccacgaacatccccagccgccccctggactactggggccaggggaccctggtgaccgtctccagcgcctccaccaagggc

SEQ ID NO: 12000 - RNA, 384 nt, synthetic construct
  misc_feature 1..384: note = derived and/or modified sequence opt1 from anti-HIV_Chain
  source 1..384: mol_type = other RNA
caggtgcagctgcaggagagcggccccgggctcgtcaagccgtccggcaccctgagcctgacctgcaacgtgtacgggggctccatgatcagctactactggtcctggatccgccagccgcccgggaagggcctcgagtggatcggccacgtgtacaacagcgggaacacgaagtactcccccagcctgaagaaccgggtcaccatctccatggacaccagccgcaacctgttctccctcaaggtgaccagcgtgacgcccgccgacaccgccgtctactactgcgcgcgggccgactacgacaacatctgggactcccgcggcgggttcgacctgtggggccaggggaccctggtgaccgtgagctccgccagcacgaagggc

SEQ ID NO: 12001 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgaagaagcccgggtccagcgtgaaggtctcctgcaaggccagcggcgggaccctctccagctacaccatctcctgggtgcgccaggcgccgggccaggggctggagtggatgggccggctgatccccctcgtggacatcacgacctacgcccagaagttccagggccgcgtcaccatcaccgccgacacgagcaccaacaccgcctacatggagctgtccaacctgcggagcgaggacaccgccatctaccactgcgcgacgtccaccatgatcgccgccgtgatcaacgacgccttcgacctctgggggcagggcaccaccgtgacggtcagctccgcgagcaccaagggg

SEQ ID NO: 12002 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgaagaagcccggggcctccgtgaagatcagctgcaaggcgtccggctacagcttccgcaactacgccgtccactgggtgcggcaggccccggggcagggcctcgagtggatgggggagatcaacggcggcaacgggaacaccgagtactcccagaagtcccagggccgcctgaccatcacgcgggacatcagcgccaccaccgcctacatggagctgagctccctccgcagcgacgacaccgcggtgtactactgcgcccgggtcgcctacgtgcacgtggtcacgacccgctccctggacaactgggggcagggcaccctggtgaccgtgagctccgccagcacgaagggg

SEQ ID NO: 12003 - RNA, 384 nt, synthetic construct
  misc_feature 1..384: note = derived and/or modified sequence opt1 from anti-HIV_Chain
  source 1..384: mol_type = other RNA
caggtgcgcctgagccagtccggcgccgccgtcatgaagaccggggcgagcgtgaccatctcctgcgagacggagggcttcaacttcgtgaactacatcatccactgggtccggcggcccccggggcgcggcttcgagtggctcgggatgatcgacccccgcaacggccacccctggttcgcccagaccgtgcggggccgcctgagcctgcggcgcgacaccttcaacgagatcgtgtacatgaccctctccgggctgacgaccgacgacaccggcctgtacttctgcgcccggaacgagccccagtaccacagcctcccggggatgttcgactactggggccaggggacccccgtcacggtgtccagcgcctccaccaagggc

SEQ ID NO: 12004 - RNA, 384 nt, synthetic construct
  misc_feature 1..384: note = derived and/or modified sequence opt1 from anti-HIV_Chain
  source 1..384: mol_type = other RNA
caggtgcgcctgagccagtccggcgccgccgtcgtgaagaccggggcgagcgtgaccatctcctgcgagacggagggctacaacttcgtcaactacatcatccactgggtgcggcggcccccggggcgcggcttcgagtggctcgggatgatcgacccccgcaacggccacccctggttcgcccagaccgtgcggggccgcctgagcctgcggcgcgacaccttcaaggagaccgtctacatgacgctctccgggctgaccagcgacgacaccggcgtgtacttctgcgcccggaacgagccccagtaccactccctgccggggatgttcgactactggggccacgggacccccgtgacggtcagctccgccagcaccaagggc

SEQ ID NO: 12005 - RNA, 384 nt, synthetic construct
  misc_feature 1..384: note = derived and/or modified sequence opt1 from anti-HIV_Chain
  source 1..384: mol_type = other RNA
cagggccagctggtgcagagcgggggcggggtcaagaagctcggcacctccgtgaccatcagctgcctggcctccgagtacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgaccagcgcgtccacgagc

SEQ ID NO: 12006 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgaagaagcccggggcctccgtgaaggtcagctgcaaggcgtccggctacaccttcaccagctacgacatcaactgggtgcgccaggccacggggcagggcctcgagtggatggggtggatgaacccgaactccggcaacaccggctacgcccagaccttccaggggcgggtgaccatgacgcgcaacaccagcatctccaccgcctacatggagctgagctccctgcggagcgaggacaccgccgtctactactgcgcgcgcgaccggtggctcccccagtactactactacggcatggacgtgtgggggcagggcacgaccgtgaccgtctccagcgcctccaccaagggg

SEQ ID NO: 12007 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgaagaagcccgggtccagcatgaaggtgtcctgcaagagctccggcgggaccttcagcaaccacgccatctcctgggtccgccaggcgccgggcaaggggctcgagtggatgggcggcatcatccccatgagcgggaccacgaactacctgcagaagttccagggccgggtgaccatcaccgccgacgagttcgccaccacggcctacatggagctgtccagcctcacctccgaggacaccgccgtgtactactgcgcgcgcgcccgggccgacagccacacccccatcgacgccttcgacatctgggggcccggcacgcgcgtcatcgtgtccagcgcgtccaccaagggg

SEQ ID NO: 12008 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgaagaagcccggggcctccgtgaaggtcagctgcaaggtgtccggctacaccctcaccgagctgagcatccactgggtgcgccaggcgccggggaagcggctggagtggatgggcgggttcgaccccgaggacggcgagcgcatctacgcccagaagttccagggccgggtcacgatgaccgaggacacctccaccgacacggcctacatggagctcaacagcctgcgctccgacgacaccgccgtgtactactgcgccaccgggggcctgtactgcagctccatcagctgcatcatggacgtgtgggggcagggcaccacggtcaccgtgtccagcgcgtccaccaagggg

SEQ ID NO: 12009 - RNA, 384 nt, synthetic construct
  misc_feature 1..384: note = derived and/or modified sequence opt1 from anti-HIV_Chain
  source 1..384: mol_type = other RNA
caggtgcagctggtccagagcggcgccgaggtgaagatgcccggggcctccgtgaaggtcagctgcaaggtgtccggctacagcctcaccgagctgtccatccactgggtgcgccaggcgccggggaagcggctggagtggatgggcgggttcgaccccgaggacgacgagcgcatctacgcccagaagttccaggaccgggtcaccatgacggaggacaccagcaccgacaccgcctacatggacctcaactccctgcgcagcgaggacacggccgtgtactactgcaccaccggcggcctgtactgctccagcatctcctgcatcatggacgtgtgggggcagggcaccacggtcatcgtgagctccgccagcaccaagggg

SEQ ID NO: 12010 - RNA, 387 nt, synthetic construct
  misc_feature 1..387: note = derived and/or modified sequence opt1 from anti-HIV_Chain
  source 1..387: mol_type = other RNA
gaggtgcagctgagcgagtccggcgggggcttcgtcaagcccgggggcagcctccgcctgtcctgcgaggccagcgggttcaccttcaacaactacgccatgtcctgggtgcggcaggcgccgggcaagggcctggagtgggtgagcgtcacctccgcccacgggggcagcgcctactacggggagttcgtgaagggccgcttcacgatgtcccgggaccacttcatcgacaccgtgtacctcgagatgaacgggctgaccgtcgaggacaccgccgtgtactactgcgtgcgcgtcacgttctaccacgagggcagcggctactactaccgggccgggaactacttcgactcctggggcaaggggacccgcgtggtggtcagcgcg

SEQ ID NO: 12011 - RNA, 387 nt, synthetic construct
  misc_feature 1..387: note = derived and/or modified sequence opt1 from anti-HIV_Chain
  source 1..387: mol_type = other RNA
gaggtgcagctgagcgagtccggcgggggcttcgtcaagcccgggggcagcctccgcctgtcctgcgaggccagcgggttcaccttcaacaactacgccatgtcctgggtgcggcaggcgccgggcaagggcctggagtgggtgagcgtcacctccgcccacgggggcagcgcctactacggggagttcgtgaagggccgcttcacgatgtcccgggaccacttcatcgacaccgtgtacctcgagatgaaccgcctgaccgtcgaggacaccgccgtgtactactgcgtgcgggtcacgttctaccacgaggggagcggctactactaccgcgccggcaactacttcgactcctgggggaagggcacccgggtggtggtcagcgcg

SEQ ID NO: 12012 - RNA, 387 nt, synthetic construct
  misc_feature 1..387: note = derived and/or modified sequence opt1 from anti-HIV_Chain
  source 1..387: mol_type = other RNA
gaggtgcagctgagcgagtccggcgggggcgtcgtgaagcccgggggcagcctccgcctgtcctgcgaggccagcgggttcaccttctccaactacgccatgagctgggtgcggcaggcgccgggcaagggcctggagtgggtctccgtgaccgggggccacgggacgtacggctactacggggagttcgtgaagggccgcttcaccatcagccgggaccactccatggacaccgtctacctccagatgaaccgcctgcgggtggaggacaccgccgtgtactactgcgtccgcacgccctactaccacgagagctccggctactactaccgggccgggaactacttcgacttctggggcaaggggaccctggtgatcgtgagcgcc

SEQ ID NO: 12013 - RNA, 387 nt, synthetic construct
  misc_feature 1..387: note = derived and/or modified sequence opt1 from anti-HIV_Chain
  source 1..387: mol_type = other RNA
gaggtgcagctgagcgagtccggcgggggcttcgtcaagcccgggggcagcctccgcctgtcctgcgaggccagcgggttcaccttcaacaactacgccatgggctgggtgcggcaggcgccgggcaaggggctggagtgggtgtccgtcaccagcgcccacggcgggtccgcctacttcggcgagttcgtgaaggggcgcttcacgatgagccgggaccacttcatcgacaccgtgtacctcgagatgaaccgcctgaccgtcgaggacaccgccgtgtactactgcgtgcgggtcacgttctaccacgagggctccggctactactaccgcgccgggaactacttcgacagctggggccaggggaccctggtgatcgtgtccgcg

SEQ ID NO: 12014 - RNA, 387 nt, synthetic construct
  misc_feature 1..387: note = derived and/or modified sequence opt1 from anti-HIV_Chain
  source 1..387: mol_type = other RNA
caggtgcagctggtcgagagcggcgggggcctcgtgcagcccgggggctccctgcggctgagctgcgccgcctccgggttcaccttcagcacccactggatgcactgggtgcggcaggcgccgggcaagggcctcgtctgggtgtcccgcatccacagcgacgggcggtccacgagctacgccgactccgtgaagggccgcttcaccatcagccgggacaacgccaagaacaccctgtacctgcagatgaactccctccgcgccgaggacaccgccgtctactactgcgcgcgcggggccgccgtgttcggcgtggtcatcatcgggggcatggacctgtggggccaggggacgaccgtgaccgtgagctccgccagcaccaagggc

SEQ ID NO: 12015 - RNA, 387 nt, synthetic construct
  misc_feature 1..387: note = derived and/or modified sequence opt1 from anti-HIV_Chain
  source 1..387: mol_type = other RNA
caggtgcagctggtcgagagcggcggggccctcgtgcagcccggcgggtccctgcgcctgagctgcgccgcgtccggcttcagcttctccagctacgccatgtcctgggtgcggcaggccccggggaagggcctcgagtgggtcagcgccatctcccgcagcggcgggtccacctactacgccgacagcgtgaagggccggttcaccatctccatcgacaacagcaacaacacgctgtacctgcagatgaactccctccgcgtggaggacaccgcggtctactactgcgccaagcgggaggccttctactacggggccggcgggtacggcatggacgtgtggggccaggggaccaccgtgacggtcagctccgcgagcaccaagggc

SEQ ID NO: 12016 - RNA, 387 nt, synthetic construct
  misc_feature 1..387: note = derived and/or modified sequence opt1 from anti-HIV_Chain
  source 1..387: mol_type = other RNA
ttccagggccacctggtgcagagcgggggcggggtcaagaagcccggcacctccgtgaccctcagctgcctggcctccgagtacacgttcaccgagttcaccatccactggatccgccaggccccggggcagggccccctgtggctcggcctgatcaagcggagcgggcgcctgatgacctcctaccggttccaggaccgcctcagcctgcggcgcgaccggtccacgggcaccgtgttcatggagctgcgcagcctccggaccgacgacaccgcggtctactactgcgcccgcgacgggctgggcgagctggcccccgcctaccactacgggatcgacgcctggggccagggcacgaccgtgatcgtgacctccgcgagcacctcc

SEQ ID NO: 12017 - RNA, 387 nt, synthetic construct
  misc_feature 1..387: note = derived and/or modified sequence opt1 from anti-HIV_Chain
  source 1..387: mol_type = other RNA
cagggcctgctcgtgcagagcgggggcggggtcaagaagctgggcacctccgtgaccatcagctgcctggcctccgagtacacgttcaacgagttcgtgatccactggatccgccaggcccccgggcagggcccgctctggctgggcctgatcaagcggagcgggcgcctcatgacctcctaccagttccaggaccggctgagcctgcgccgggaccgctccaccggcaccgtcttcatggagctccgggggctgcgcgtggacgacacggcggtgtactactgcgcccgggacggcctgggggaggtcgcccccgcctacctctacggcatcgacgcctggggccaggggaccaccgtgatcgtgaccagcgcgtccacgaagggc

SEQ ID NO: 12018 - RNA, 387 nt, synthetic construct
  misc_feature 1..387: note = derived and/or modified sequence opt1 from anti-HIV_Chain
  source 1..387: mol_type = other RNA
aacttcatgctgacccagcccgccagcgtgtccggcagccccgggcagtccatcaccatcagctgctccggcacggggagcgacatcggcgtctacaactacgtgtcctggtaccagcagcaccccgggaaggcgccccgcctcatgatctacgacgtgaccaaccggcccagcggcgtctccaaccgcttcagcggctccaagagcgggttcaccgcctccctgaccatcagcggcctgcagggggacgacgaggccgactactactgctccagctactccagcacgaacacctacgtgttcggcaccgggacccacgtgacggtcctcggccagccgaaggccaaccccaccgtgaccctgttcccgccctccagcgaggagctg

SEQ ID NO: 12019 - RNA, 387 nt, synthetic construct
  misc_feature 1..387: note = derived and/or modified sequence opt1 from anti-HIV_Chain
  source 1..387: mol_type = other RNA
cagagcgccctgacccagccccgctccgtgagcggctccccggggcagagcgtcaccatctcctgcacgggcaccagctccgacgtgggggcctacaactacgtgagctggtaccggcagcaccccggcaaggcgcccaagctcatgatcaacgacgtctccaagcgccccagcggggtgccggaccggttctccggcagcaagtccggcaacaccgccagcctgaccatctccgggctgcaggccgaggacgaggccgactactactgctgcagctacgccggcacgtactcctacgtgttcgggaccggcaccaaggtcaccgtgctcgggcagcccaaggcgaaccccacggtgaccctgttcccgcccagctccgaggagctg

SEQ ID NO: 12020 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcgggctcaagaagcccggcacctccgtcaccatcagctgcctggcctccgagtacacgttcaacgagttcgtgatccactggatccgccaggccccggggcagggccccctgtggctcggcctgatcaagcggagcgggcgcctgatgaccgcgtacaacttccaggaccggctctccctgcgccgggaccgcagcaccggcaccgtgttcatggagctgcgggggctccgccccgacgacacggccgtctactactgcgcccgggacggcctgggggaggtggcccccgactaccgctacggcatcgacgtgtggggccaggggtccaccgtcatcgtgaccgccgcgagcaccaagggc

SEQ ID NO: 12021 - RNA, 387 nt, synthetic construct
  misc_feature 1..387: note = derived and/or modified sequence opt1 from anti-HIV_Chain
  source 1..387: mol_type = other RNA
aacttcatgctgacccagcccccgagcgcctccggcgcccccgggcagcgcgtgaccatcagctgctccggcgggcccagcaacgtcggcgggaactacgtgtactggtaccggcagttccccggcacggcgcccaacctcctgatcctgcgcgacgaccagcggccctccggcgtgcccgaccgcttcagcgcctccaagagcgggaactccgccagcctcgccatctccggcctgcggcccgacgacgaggccttctacttctgcgcgacctacgacagcgacgggtccatccgcctgttcggcgggggcaccaccctcacggtcctgagccagccgaaggccgccccctccgtgaccctgttcccgcccagctccgaggagctc

SEQ ID NO: 12022 - RNA, 387 nt, synthetic construct
  misc_feature 1..387: note = derived and/or modified sequence opt1 from anti-HIV_Chain
  source 1..387: mol_type = other RNA
cagctggtgctcacccagcccccgagcgtctccggcgcccccgggcagcgcgtgaccatcagctgctccggcgggcccagcaacgtgggcgggaacctggtctactggtacaagcagttccccggcacggcccccaagctgctcatccggcgcgacgaccagcggccctccggcgtgcccgaccgcttcagcgggtccaagagcggcaactccgcgagcctgaccatctccgggctgcggcccgacgacgaggccttctacttctgcgccacctacgacagccagggctccacccgcctcttcgggggcggcacggtgctgaccgtcctgagccagccgaaggccgccccctccgtgaccctcttcccgcccagctccgaggagctg

SEQ ID NO: 12023 - RNA, 387 nt, synthetic construct
  misc_feature 1..387: note = derived and/or modified sequence opt1 from anti-HIV_Chain
  source 1..387: mol_type = other RNA
aacttcatgctgacgcagccgcccagcgtgtccggcgcccccgggcagcgcgtcaccatcagctgctccggcgggcccagcaacgtgggcgggaacctcgtgtactggtacaagcagttccccggcacggcccccaagctgctgatccggcgcgacgaccagcggccctccggcgtccccgaccgcttcagcgggtccaagagcggcaactccgcgagcctcgccatctccgggctgcggcccgacgacgaggccttctacttctgcgccacctacgacagccacggctccatccgcctgttcgggggcggcaccctcctgaccgtgctgagccagccgaaggccgcgccctccgtgaccctcttcccgcccagctccgaggagctg

SEQ ID NO: 12024 - RNA, 387 nt, synthetic construct
  misc_feature 1..387: note = derived and/or modified sequence opt1 from anti-HIV_Chain
  source 1..387: mol_type = other RNA
cagagcgccctgacccgcaccccctccgtgagcggcgccccggggcagcgggtcacgatctcctgcagcggcgggccctccaacgtgggcgggaactacgtgtactggtaccagcagttccccggcgcggcccccaagctcctgatccgccgggacgaccagcgcccgagcggcgtccccgaccggttctccgggagcaagtccggcaacagcgcctccctggccatcagcgggctccgcctggacgacgaggcctactacttctgcgcgacctacgactccggctggagcatccggctgttcgggggcggcacccgcctcaccgtgctgtcccagcccaaggccgcccccagcgtgacgctgttcccgccctccagcgaggagctc

SEQ ID NO: 12025 - RNA, 387 nt, synthetic construct
  misc_feature 1..387: note = derived and/or modified sequence opt1 from anti-HIV_Chain
  source 1..387: mol_type = other RNA
cagagcgccctgacccagcccccgtccgtgagcgccacccccggccagacggtcaccatctcctgcagcgggtccggcagcaacgtcgggggcaaccacgtgtactggtaccgccagctccccggggcggcccccaccctgctgatctccaagaccgaccaccggcccagccgcgtgcccgaccggttctccgccagcaagtccggcaacagcgcctccctcgccatcagcggcctgcgccccgacgacgaggcgatctacttctgcgccacgtacgacaccgggctgtccctccggctgttcggcgggggcacccgcctgaccgtgctcagccagcccaaggccgccccgtccgtgacgctgttcccgcccagctccgaggagctg

SEQ ID NO: 12026 - RNA, 387 nt, synthetic construct
  misc_feature 1..387: note = derived and/or modified sequence opt1 from anti-HIV_Chain
  source 1..387: mol_type = other RNA
caggtgcagctgctcgagagcggccccgggctggtcaccccgtccggcaccctgagcctcgcctgcgccgtgtccggggcgagcatctccagctcccactggtggacgtgggtgcgccagagccccggcaaggggctggagtggatcggcgagatcgaccggcgcggcaccaccaactacaacccctccctgcggagccgcgtcaccatcctcctggacaactccaagaaccagttcagcctgtccctccggagcgtgacggccgccgacaccgccgtgtactactgcaccaaggtctacgccgggctgttcaacgagcgcacctacggcatggacgtgtgggggcacggcacgaccgtgctggtctccagcgcgtccaccaagggg

SEQ ID NO: 12027 - RNA, 387 nt, synthetic construct
  misc_feature 1..387: note = derived and/or modified sequence opt1 from anti-HIV_Chain
  source 1..387: mol_type = other RNA
caggccgtggtcacgcagccgcccagcgtgtccgccacccccggccagacggtgaccatcagctgctccgggagcggctccaacgtcgggggcaaccacgtgtactggtaccgccagctgcccggggcggcccccaccctcctgatcagcaagaccaaccggcgcccctcccaggtgcccgaccggttcagcggctccaagagcggcaactccgccagcctggccatctccgggctccgccccgacgacgaggccgactacttctgcgcgacgtacgacaccgacctgagcctgcgcctcttcggcgggggcacccggctgaccgtcctgtcccagcccaaggccgccccgagcgtgaccctcttcccgccctccagcgaggagctg

SEQ ID NO: 12028 - RNA, 387 nt, synthetic construct
  misc_feature 1..387: note = derived and/or modified sequence opt1 from anti-HIV_Chain
  source 1..387: mol_type = other RNA
cagagcgccctgacccagcccccgtccgtgagcggcacccccgggcagaacgtcacgatctcctgcagcggcgggggctccgacgtcgggggcaacctcgtgagctggtaccagcacttccccggcgccgcgcccaagctgctgatccaccgcgacaaccagcggccgtccggggtgcccgaccgcttcagcgccctcaagtccggcaacagcgcctccctggccatcagcgggctgcggtccgacgacgaggccttctacttctgcgcggtgtacgacagctccctcagcctgggcctgttcgggggcggcaccaagctcaccgtgctgtcccagcccaaggccgcccccagcgtcaccctgttcccgccctccagcgaggagctc

SEQ ID NO: 12029 - RNA, 387 nt, synthetic construct
  misc_feature 1..387: note = derived and/or modified sequence opt1 from anti-HIV_Chain
  source 1..387: mol_type = other RNA
cagagcgccctgacccagcccccgtccgccagcggcacccccgggcagcgcgtgacgatctcctgcagcggcgggggctccaacatcgggggcaacctcgtcagctggtaccagcacttccccggcaccgcgcccaagctgctgatctaccggaacgaccagcgcccgtccggggtgcccgaccggttcagcggctccaagagcgggacctccgccagcctcaccatctccggcctgcgcagcgacgacgaggccacgtacttctgcgccgcctacgactccagcctgtccctccggctgttcgggggcggcaccaccctgaacgtgctcagccagcccaaggcggccccctccgtcaccctgttcccgcccagcagcgaggagctg

SEQ ID NO: 12030 - RNA, 387 nt, synthetic construct
  misc_feature 1..387: note = derived and/or modified sequence opt1 from anti-HIV_Chain
  source 1..387: mol_type = other RNA
cagagcgccctgacccagcccccgtccgtgagcgccacccccggccagacggtcaccatctcctgcagcgggtccggcagcaacgtcgggggcaaccacgtgtactggtaccgccagctccccggggcggcccccaccctgctgatctccaagaccaaccaccggcccagccaggtgcccgaccgcttctccgccagcaagtccggcaacagcgcctccctcgccatcagcggcctgcggcccgacgacgaggcggactacttctgcgggacgtacgacacctccctgagcctccgcctgttcggcgggggcacccggctgaccgtgctctcccagcccaaggccgccccgagcgtgacgctgttcccgccctccagcgaggagctg

SEQ ID NO: 12031 - RNA, 387 nt, synthetic construct
  misc_feature 1..387: note = derived and/or modified sequence opt1 from anti-HIV_Chain
  source 1..387: mol_type = other RNA
cagagcgtgctgacccaggtcctctccgtgagcggcacccccgggcagcgcgtgatcatctcctgcagcggcacgtccagcaacgtcgggggcaacctggtgtcctggtaccagcacctcccgggggccgcgccccggctgctgatccaccgcgacgaccagcggcccagcggcgtgcccgaccgcttctccggcagcaagtccgggaacagcgcctccctggtcatcagcggcctccggtccgacgacgaggccgactacttctgcggggcctacgacagcaccttctccctgccggtgttcggcgggggcacccgcctgaccgtgctcagccagcccaaggccgccccctccgtcacgctgttcccgcccagcagcgaggagctg

SEQ ID NO: 12032 - RNA, 387 nt, synthetic construct
  misc_feature 1..387: note = derived and/or modified sequence opt1 from anti-HIV_Chain
  source 1..387: mol_type = other RNA
cagagcgccctgacccagcccccggccacctccggcacgcccgggcagcgcgtgaccatcagctgctccggcgggggcagcaacgtcgggggcaacctcgtgtcctggtaccagcagttccccggcgcggcccccaagctgatcctgcaccgggacgggcagcgccccagcggcgtgcccgaccggttctccgccagcaagtccgggaccagcgcctccctcaccatcagcggcctgcgctccgacgacgaggccacgtacttctgcgcggccttcgacagcgccctgtccctccccctgttcgggggcggcaccaagctgaccgtcctcagccagcccaaggccgcgccgtccgtgaccctgttcccgcccagctccgaggagctg

SEQ ID NO: 12033 - RNA, 387 nt, synthetic construct
  misc_feature 1..387: note = derived and/or modified sequence opt1 from anti-HIV_Chain
  source 1..387: mol_type = other RNA
cagctggtgctcacccagcccccgagcgtctccgccacccccggccagacggtgaccatcagctgctccgggagcggctccaacgtcgggggcaaccacgtctactggtaccgccagctgcccggggccgcgcccaccctggtgatcagcaagaccgaccaccggccctcccgcgtgcccgaccggttcagcggctccaagagcggcaactccgccagcctcgccatctccgggctgcgccccgacgacgaggccgcctacttctgcgcgacgtacgacaccggcctgagcctccggctgttcgggggcgggacccgcctggccgtgctctcccagcccaaggccgccccgagcgtgaccctgttcccgccctccagcgaggagctg

SEQ ID NO: 12034 - RNA, 387 nt, synthetic construct
  misc_feature 1..387: note = derived and/or modified sequence opt1 from anti-HIV_Chain
  source 1..387: mol_type = other RNA
cagagcgccctgacccagcccccgtccgtgagcggcacccccgggcagaacgtcacgatctcctgcagcggcgggggctccaacgtcgggggcaacctcgtgagctggtaccagcacttccccggcgccgcgcccaagctgctgatccaccgcgacaaccagcggccctccggggtgcccgaccgcttcagcgtgctcaagtccggcaacagcgcctccctggccatcagcgggccccggtccgacgacgaggccttctacttctgcgccgtgtacgacagctccctgagcctcggcctgttcgggggcggcaccaagctgaccgtcctctcccagcccaaggcggccccgagcgtgaccctgttcccgccctccagcgaggagctg

SEQ ID NO: 12035 - RNA, 387 nt, synthetic construct
  misc_feature 1..387: note = derived and/or modified sequence opt1 from anti-HIV_Chain
  source 1..387: mol_type = other RNA
cagacggtggtcacccagcccccgagcgcctccggcacgcccgggcagcgggtgaccatcagctgctccggcgggggcagcaacatcgggggcaacctggtgtcctggtaccagcacttccccggcgccgcgcccaagctcctgatctaccggaacgaccagcgcccgagcggggtccccgaccggttctccggcagcaagtccgggaccagcgcctccctgaccatcagcggcctccgctccgacgacgaggccacgtacttctgcgccgcctacgactgcaccctgagcctgcgcctcttcgggggcggcaccaccctgaacgtgctgtcccagcccaaggcggcccccagcgtgaccctcttcccgccctccagcgaggagctg

SEQ ID NO: 12036 - RNA, 387 nt, synthetic construct
  misc_feature 1..387: note = derived and/or modified sequence opt1 from anti-HIV_Chain
  source 1..387: mol_type = other RNA
cagagcgccctgacccagaccccctccgtgagcggcgccccggggcagcgcgtcacgatctcctgcagcggcgggccctccaacgtgggcgggaactacgtgtactggtaccagcagttccccggcgcggcccccaagctcctgatccggcgcgacgaccagcggccgagcggcgtccccgaccgcttctccgggagcaagtccggcaacagcgcctccctggccatcagcgggctccggctggacgacgaggcctactacttctgcgcgacctacgactccggctggagcatccgcctgttcgggggcggcacccggctcaccgtgctgtcccagcccaaggccgcccccagcgtgacgctgttcccgccctccagcgaggagctc

SEQ ID NO: 12037 - RNA, 387 nt, synthetic construct
  misc_feature 1..387: note = derived and/or modified sequence opt1 from anti-HIV_Chain
  source 1..387: mol_type = other RNA
cagagcgtgctgacccagcccccgtccgccagcggcgcccccgggcagcgcgtcaccatctcctgcagcggcgggccctccaacgtgggcgggaactacgtgtactggtaccggcagttccccggcacggcgcccaacctcctgatcctgcgcgacgaccagcggcccagcggcgtccccgaccgcttctccgccagcaagtccgggaacagcgcctccctcgccatcagcggcctgcggcccgacgacgaggccttctacttctgcgcgacctacgactccgacgggagcgtgcgcctgttcggcgggggcaccaccctcacggtgctgtcccagccgaaggccgcccccagcgtcaccctgttcccgccctccaacggcgggcgg

SEQ ID NO: 12038 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagcccggcacctccgtgaccatcagctgcctcgcctccgagtacacgttcaacgagttcgtgatccactggatccgccaggccccggggcagggccccctgtggctgggcctcatcaagcggagcgggcgcctgatgacctcctacaagttccaggaccggctgaacctccgccgggaccgcagcaccggcaccgtcttcatggagctgcgggggctgcgccccgacgacacggcggtgtactactgcgcccgggacggcctcggggaggtggcccccgactaccgctacggcatcgacgtctggggccaggggtccaccgtgatcgtgaccgccgccagcaccaagggc

SEQ ID NO: 12039 - RNA, 387 nt, synthetic construct
  misc_feature 1..387: note = derived and/or modified sequence opt1 from anti-HIV_Chain
  source 1..387: mol_type = other RNA
gaggtgcagctggtcgagagcggcgccgaggtgaagaagcccggggcctccgtgaaggtcgcctgcaaggtgagcggcaagaagctctccgacctgagcatccactgggtgcgccaggccccggggaagggcctggagtggatgggcgggttcgacgaggaggacggcaagatctcctacgagcggaagttccaggggcgcgtcaccatgaccgaggacacggcccgggacaccgccttcatggagatgagctccctccgcagcgacgacaccgccgtgtacttctgcgcggccgcgccccggctggacctgggcgagctctccagcgggttccacttctggggcctggggaccctggtgtccgtcagctccgccagcacgaagggc

SEQ ID NO: 12040 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcgggggcaagaagctcgggacctccgtcaccatcagctgcctggcctccgagtacacgttcaacgagttcgtgatccactggatccgccaggcccccggccagggcccgctgtggctcgggctgatcaagcggagcggccgcctgatgacctcctaccagttccaggaccggctcagcctgcgccgggaccgctccaccgggaccgtgttcatggagctgcggggcctccgcgtcgacgacacggcggtgtactactgcgcccgggacgggctgggcgaggtggcccccgcctacctgtacggcatcgacgcctgggggcagggcaccaccgtcatcgtgagctccgcgagcaccaagggg

SEQ ID NO: 12041 - RNA, 387 nt, synthetic construct
  misc_feature 1..387: note = derived and/or modified sequence opt1 from anti-HIV_Chain
  source 1..387: mol_type = other RNA
gaggtgcagctggtcgagagcggcgccgaggtgaagaagcccggggcctccgtgaaggtcagctgcaaggtgtccggctacaccctcagcgacctgtccatgcactgggtgcgccaggcgccggggaagggcctggagtggatgggcgggttcgacgaggaggacggcgagatcacctacgcccagaagttccaggggcgggtcagcatgacggaggacacctcccgcgacaccgcctacatggagctcagctccctgcggagcgaggacaccgccgtgtactactgcgccacggcgccccgcctggagctcggcgagctgtccagcgggttccactactggggcctggggaccctcgtgaccgtctccagcgcctccaccaagggc

SEQ ID NO: 12042 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagaccggcacctccgtgacgatcagctgcctcgcctccgagtacaccttcaccgagttcaccatccactggatccgccaggcccccgggcagggcccgctgtggctgggcctcatcaagcggagcgggcgcctgatgacggcgaaccggttccaggaccgcctgtccctccggcgcgaccggagcaccggcaccgtgttcatggagctgcgctccctgcggatcgacgacaccgccgtctactactgcgcccgcgacgggctcggcgagctggcccccgcctaccactacgggatcgacgtgtggggccagggcacgaccatcatcgtgaccagcgcgtccaccaagggg

SEQ ID NO: 12043 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagctcggcacctccgtgaccatcagctgcctggcctccgagtacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgaccagcgcgtccacgaagggc

SEQ ID NO: 12044 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagctcggcacctccgtgaccatcccctgcctggccagcgagtacacgttcaacgagttcgtgatccactggatccgccaggccccggggcagggccccctgtggctcggcctgatcaagcggtccgggcgcctgatgaccagctaccagttccaggaccggctctccctgcgccgggaccgcagcaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgacctccgcgagcacgaagggc

SEQ ID NO: 12045 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagcccggcacctccgtgaccatcagctgcctcgcctccgagtacacgttcaacgagttcgtgatccactggatccgccaggccccggggcagggccccgtctggctgggcctgatcaagcggagcgggcgcctcatgacctcctacaagttccaggaccggctgagcctgcgccgggaccgctccaccggcaccgtgttcatggagctccgggggctgcgcctggacgacacggcggtgtactactgcgcccgggacggcctcggggaggtcgcccccgcctacctgtacggcatcgacgcctggggccaggggagcaaggtgatcgtgacccccgcgtccaccaagggc

SEQ ID NO: 12046 - RNA, 387 nt, synthetic construct
  misc_feature 1..387: note = derived and/or modified sequence opt1 from anti-HIV_Chain
  source 1..387: mol_type = other RNA
caggcccgcctggaccagtggggcaccgggctgctgaagcccagcgagaccctgtccctcaagtgcgccgtgttcggcgtcctgttcacggactacaactggacctgggtgcggcagagcccggggaaggagctggagtggatcggccacctcgaccaccgcgggggcggcaactacaacccctccctggagagccgggtgaccatctccctggactacagcaaggcgcagttctccctccacctcaagagcgtcaccgtggccgacacggcccgctactactgcgccggggccgtgaagggcttctggttcgacgacccctacacctggttcgggccctggtcccagggcaccctggtcaccgtggcgagcgcctccacgaagggg

SEQ ID NO: 12047 - RNA, 387 nt, synthetic construct
  misc_feature 1..387: note = derived and/or modified sequence opt1 from anti-HIV_Chain
  source 1..387: mol_type = other RNA
caggcccgcctggaccagtggggcaccgggctgctgaagcccagcgagaccctgtccctcaagtgcgccgtgttcggcgtcctgttcacggactacaactggacctgggtgcggcagagcccggggaagggcctggagtggatcgggcacctcgaccaccgcggcggcgggtcctacaaccccagcctggagtcccgggtgagcatctccctggactacagcaaggcgcagttctccctccacctcaagagcgtcaccgtggccgacaccgccctgtactactgcgccggcgccgtgaaggggttctggttcgacgagccctccacgtggttcggcccctggagccaggggaccatggtcaccgtggcgtccgccagcaccaagggc

SEQ ID NO: 12048 - RNA, 387 nt, synthetic construct
  misc_feature 1..387: note = derived and/or modified sequence opt1 from anti-HIV_Chain
  source 1..387: mol_type = other RNA
cagggccacctggtgcagagcgggggcggggtcaagaagctcggcacctccgtgaccatcagctgcctggcctccgaggacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgaccagcgcgtccacgaagggc

SEQ ID NO: 12049 - RNA, 387 nt, synthetic construct
  misc_feature 1..387: note = derived and/or modified sequence opt1 from anti-HIV_Chain
  source 1..387: mol_type = other RNA
caggtgcagctggtccagagcgaggccgaggtgaagaagcccggctccagcgtgaaggtctcctgcaaggccagcgggggcaccttccgcgggtacaccatctcctgggtgcggcaggcgccgggccaggggctcgagtggatgggccgcatcatccccatcctgggcaaggccatctacgcccccagcttccaggggcgggtgacgctgaccgccgacaagtccaccggcaccgcctacatggagctcagccgcctgcggtccgacgacacggcggtctactactgcgccaaggtgaagatgcgcgggagctccggctactactacctgttcgacgactgggggcagggcaccctcgtgaccgtcagctccgccagcaccaagggc

SEQ ID NO: 12050 - RNA, 387 nt, synthetic construct
  misc_feature 1..387: note = derived and/or modified sequence opt1 from anti-HIV_Chain
  source 1..387: mol_type = other RNA
caggcccgcctggaccagtggggcaccgggctcctgaagcccagcgagaccctgtccctcaagtgcgccgtgttcggcgtcctgttcacggactacaactggacctgggtgcggcagagcccggggaagggcctggagtggatcgggcacctcgaccaccgcggcggcgggaactacaacccctccctggagagccgggtgaccatctccctggactacagcaaggcgcagttctccctccacctcaagagcgtcaccgtggccgacacggccctgtactactgcgccggcgccgtgaaggggttctggttcgacgaggtctacaactggttcggcccctggtcccaggggaccctggtgaccgtggcgagcgcctccaccaagggc

SEQ ID NO: 12051 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagcccggcacctccgtgaccatcagctgcctcgcctccgagtacacgttcaccgagttcaccatccactggatccgccaggccccggggcagggccccctgtggctgggcctcatcaagcggagcgggcgcctgatgaccgcgtaccggttccaggaccgcctgtccctccggcgcgaccggagcacgggcaccgtgttcatggagctgcgcaacctgcggatggacgacaccgccgtctactactgcgcccgcgacgggctcggcgagctggcccccgcctaccagtacgggatcgacgtgtggggccagggcaccacggtgatcgtctccagcgcgtccaccaagggg

SEQ ID NO: 12052 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccaggtgaagcggccgggggcctccatccgcctcagctgcgagtccagcggctaccggttccaggactacatcgtggcctggatccgccagacccgggggcagggcttcgagttcgtcgggatggtgaacccccgcggcggccggccctggccctccagccgcttccgggaccgcgtgaccctgacgcgggacatcgagtccgagaccttctacctggggctcaacgacctgaccagcgacgacaccgcgacgtacttctgcgcccgcctggaggccgacggctccgactacagcccgaagatgttcgacttctgggggcagggcaccaagatcgtcgtgtcccccgccagcaccaagggg

SEQ ID NO: 12053 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccaggtgaagaccccgggggcctccatgcgggtgagctgcgaggcctccggctaccgcttcctcgactacatcatcgtctggatccggcagacccacgggcagcacttcgagtacgtgggcatgatcaacccccgcgggggcacgccctggcccagctccaagttccgggaccgcctgagcctgacccgggacatccacaccgacaccttctacctcggcctgaacaacctggggtccgacgacacggcgatctacttctgcgcccgcctcgaggccgacggcgacgactacagcccgaagatgttcgaccactgggggcagggcacccggatcatcgtgtccgccgccagcaccaagggg

SEQ ID NO: 12054 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccaggtgaagaccccgggggcctccatccggctcagctgcgaggcctccggctaccgcttcctggactacttcatcgtgtgggtccggcagacccccgggcagggcttcgagtacgtggggatgatcaacccccgcggcggccggccctggagctcctggaagttccgcgaccggctgagcctcacgcgcgagatcgacaccgacaccttctacctggggctgtccaacctccggagcgacgacaccgcgatctacttctgcgcccgcctggaggccgacggcgacgactactccccgaagatggtggactactgggggcagggcacgaagatcatcgtcagcgccgcctccaccaagggg

SEQ ID NO: 12055 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccaggtgaagcggccgggggcctccatccgcctcagctgcgagacctccggctaccggttccaggactacatcgtggcctggatccgccagacccgggggcagcgcttcgagttcgtcggcatggtgaacccccgcgggggccggccctggcccagctccaagttccgggaccgcgtgacgctgacccgggacatcgagagcgagaccttccacctgggcctcaacgacctgacctccgacgacacggcgacctacttctgcgcccgcctggaggccgacggggccgactacagcccgaagatgttcgacttctggggccaggggaccaagatcgtcgtgtcccccgccagcaccaagggc

SEQ ID NO: 12056 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccaggtgaagaccccgggggcctccatgcggatcagctgcgaggcctccggctaccgcttccaggactacatcatcgtgtggatccggcagacccacgggcagggcttcgagtacgtcgggatgatcaacccccgcggcggcacgccctggagctccagcaagttccgggaccgcctctccctgacccgggacatctacaccgacaccttctacctggggctcaacaacctgggcagcgacgacacggcgatctacttctgcgcccgcctggaggccgacgggggcgactactcccccaagatgttcgactactgggggcagggcacccggatcatcgtgagcgccgcctccaccaagggc

SEQ ID NO: 12057 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagcccggcgcctccgtgaccatcagctgcctcgcctccgagtacaccttcaacgagttcgtgatccactggatccgccaggcgccggggcagggccccctgtggctgggcctcatcaagcggagcgggcgcctgatgacggcctacaagttccaggaccggctgtccctccgccgggaccgcagcaccggcaccgtcttcatggagctgcgggggctgcgccccgaggacaccgccgtgtactactgcgcccgggacggcctcggggaggtggcccccgactaccgctacggcatcgacgtctggggccaggggtccacggtgatcgtgagcgcggcctccaccaagggc

SEQ ID NO: 12058 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccagatgaagaccccgggggcctccctccggctgagctgcgaggtgtccggctaccgcttcctggactacttcatcgtgtgggtccggcagaccgggggccaggggttcgagtacgtgggcatgatcaacccccgcggcgggcggccctggagctcctggaagttccgcgaccggctcagcctgacgcgcgacatcgagaccgacaccttctacctgggcctcaacaacctgcggtccgacgacaccgccatctacttctgcgcgcgcctggaggccgacggggacaactacagccccaagatggtggactactggggccaggggacgaagatcatcgtctccccggccagcaccaagggc

SEQ ID NO: 12059 - RNA, 387 nt, synthetic construct
  misc_feature 1..387: note = derived and/or modified sequence opt1 from anti-HIV_Chain
  source 1..387: mol_type = other RNA
caggtgagcctggtccagtccggcccccaggtgaagaccccgggggccagcatgcgcgtgtcctgcgagaccagcggctaccggttcctcgactacatcatcgtctggatccgccagacgcacgggcagcacttcgagtacgtgggcatgatcaacccccgcgggggcaccccctggccctccagcaagttccgggaccggctgaccatgacccgcgacatccacacggacaccttctacctgggcctcaacaacctgcggtccgacgacaccgccatctacttctgcgcgcgcctggaggccgacggggacgactacagcccgaagatgttcgactactggggccaggggacccggatcatcgtgtccgccgccagcacgaagggc

SEQ ID NO: 12060 - RNA, 387 nt, synthetic construct
  misc_feature 1..387: note = derived and/or modified sequence opt1 from anti-HIV_Chain
  source 1..387: mol_type = other RNA
caggtgcgcctggtccagagcggcccccaggtgaagaccgccggggcctccatgcgggtgagctgcgaggcgtccggctaccgcttcctcgactacatcatcgtctggatccggcagacccacgggcagcacttcgagtacgtgggcatgatcaacccgcgcgggggcacgccctggcccagctccaagttccgggaccgcctgaccctgacccgggacatctacaccgacacgttctacctcggcctgaacaacctggggagcggcgacaccgccatctacttctgcgcccgcctcgaggccgacggggacgactactcccccaagatgttcgactactggggccaggggacccggatcatcgtgagcgccgcgtccaccaagggc

SEQ ID NO: 12061 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagcccggcacctccgtgaccatcagctgcctcgcctccgagtacacgttcaacgagttcgtgatccactggatccgccaggccccggggcagggccccgtctggctgggcctgatcaagcggagcgggcgcctcatgacctcctacaagttccaggaccggctgagcctgcgccgggaccgctccaccggcaccgtgttcatggagctccgggggctgcgcctggacgacacggcggtgtactactgcgcccgggacggcctcggggaggtcgcccccgcctacctgtacggcatcgacgcctggggccaggggagcaccgtgatcgtgacctccgcgagcaccaagggc

SEQ ID NO: 12062 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcgggctcaagaagcccggcacctccgtcaccatcagctgcctggcctccgagtacacgttcaacgagttcgtgatccactggatccgccaggccccggggcagggccccctgtggctcggcctgatcaagcggagcgggcgcctgatgaccgcgtacaacttccaggaccggctccgcctgcggcgcgaccggtccaccggcaccgtgttcatggagctgcgcgggctccggcccgacgacacggccgtctactactgcgcccgcgacggcctgggggaggtggcccccgactaccggtacggcatcgacgtgtggggccaggggagcaccgtcatcgtgaccgccgcgtccaccaagggc

SEQ ID NO: 12063 - RNA, 387 nt, synthetic construct
  misc_feature 1..387: note = derived and/or modified sequence opt1 from anti-HIV_Chain
  source 1..387: mol_type = other RNA
cagggccacctggtgcagagcgggggcggggtcaagaagctcggcacctccgtgaccatcagctgcctggtgtccgagtacacgttcaacgagttcgtcatccactggatccgccaggcccccgggcagggcccgctgtggctcggcctgatcaagcggagcgggcgcctgatgacctcctaccagttccaggaccggctcagcctgcgccgggaccgctccaccggcaccgtgttcatggagctgcgggggctccgcgtggacgacacggccgtctactactgcgcgcgggacggcctgggggaggtggcccccgcctacctgtacggcatcgacgcctggggccaggggaccaccgtgatcgtcaccagcgcctccacgaagggc

SEQ ID NO: 12064 - RNA, 387 nt, synthetic construct
  misc_feature 1..387: note = derived and/or modified sequence opt1 from anti-HIV_Chain
  source 1..387: mol_type = other RNA
cagggccagctggtgcagagcgggggcggggtcaagaagctcggcacctccgtgaccatcagctgcctggcctccgagtacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgagctccgcgagcaccaagggc

SEQ ID NO: 12065 - RNA, 387 nt, synthetic construct
  misc_feature 1..387: note = derived and/or modified sequence opt1 from anti-HIV_Chain
  source 1..387: mol_type = other RNA
cagggccacctggtgcagagcgggggcggggtcaagaagctcggcacctccgtgaccatcagctgcctggcctccgagtacacgttcaacgagttcgtgatccactggatccgccaggcccccgggcagggcccgctgtggctcggcctgatcaagcggagcgggcgcctgatgacctcctaccagttccaggaccggctcagcctgcgccgggaccgctccaccggcaccgtcttcatggagctgcgggggctccgcgtggacgacacggcggtgtactactgcgcccgggacggcctgggggaggtcgcccccgcctacctgtacggcatcgacgcctggggccaggggaccaccgtgatcgtgaccagcgcgtccacgaagggc

SEQ ID NO: 12066 - RNA, 387 nt, synthetic construct
  misc_feature 1..387: note = derived and/or modified sequence opt1 from anti-HIV_Chain
  source 1..387: mol_type = other RNA
caggtgcagctggtccagagcggctccgagctcaagaagcccggggccagcgtgaaggtgtcctgcaaggccagcggctacaccttcacctcctacgcgatcaactgggtccgccaggccccggggcagggcctggagtggatggggtggatcaacacgaacaccggcaaccccacctacgcccagggcttcaccgggcggttcgtgttcagcctggagacgtccgtgagcaccgcctacctccagatcaactccctgaaggccgaggacaccgcggtctactactgcgcccgcgacctgctcgagagccggacctactacaacgacatccgcgactgctggggccaggggacgctggtgaccgtgtccagcgcctccaccaagggc

SEQ ID NO: 12067 - RNA, 387 nt, synthetic construct
  misc_feature 1..387: note = derived and/or modified sequence opt1 from anti-HIV_Chain
  source 1..387: mol_type = other RNA
caggtgcagctggtccagagcggcgccgaggtgaagaagcccggggcctccgtgaaggtcagctgcaaggcgtccggctacaccttcaccgactactacatccactgggtgcgccaggccccggggcagggcctcgagtggatggggtggatcaaccccagcacgggcggcaccaacttcgtgcagaagttcctggggcgggtcaccatgacctccgacacgagcatcaacaccgcctacatggagctgcgccggctcaagaacgacgacgccgccatctactactgcgcgacctactccacccgccagttcttccactactactacgtgacggacgtgtggggccaggggaccaccgtcaccgtgagctccgccagcacgaagggc

SEQ ID NO: 12068 - RNA, 387 nt, synthetic construct
  misc_feature 1..387: note = derived and/or modified sequence opt1 from anti-HIV_Chain
  source 1..387: mol_type = other RNA
ttccagggccagctggtgcagagcgggggcggggtcaagaagcccggctccagcgtgaccatctcctgcctcgccagcgagtacaccttcacggagttcaccatccactggatccgccaggccccggggcagggccccctgtggctgggcctcatcaagcggtccgggcgcctgatgaccagctacggcttccaggaccggctgtccgtgcgccgggaccgcagcaccgggacggtcttcatggagctccggtccctgcgcaccgacgacaccgcggtgtactactgcgcccgggacggcctgggggagctcgcccccgcctaccactacggcatcgacgtgtggggccaggggaccacggtcatcgtgaccagcgcctccaccagc

SEQ ID NO: 12069 - RNA, 387 nt, synthetic construct
  misc_feature 1..387: note = derived and/or modified sequence opt1 from anti-HIV_Chain
  source 1..387: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggctccaacaagtactacgccgacagcgtcaaggggcggttcaccatctcccgcgacgacagcaagtccacggtgtacctccagatcaacagcctgcgggccgcggacaccgccgtgtacttctgcgcccgcgagggcgggctgcggttcctcgagtggctgttctggggccaggggaccctggtcaccgtgtccagcggcgagtccagcgcctccacgaagggc

SEQ ID NO: 12070 - RNA, 390 nt, synthetic construct
  misc_feature 1..390: note = derived and/or modified sequence opt1 from anti-HIV_Chain
  source 1..390: mol_type = other RNA
caggtgcagctggtccagagcggcgccgtggtgaagtcccccgggagctccgccaagctcagctgccgcctgctgggcgacgagttcgggacctacttcatctcctggatccggcaggcgccgggccgcgggctcgagtgggtcggcggcatcgtgccccacagccagctgcagtccagcgcccagaagttccacgggcggttcttcatcaccggcggggtgacgccgcccatcatcttcctgcagctcaccaacgtcaccttcgaggacaccggcacgtacttctgcgcccgcgagcgggggcgccaccgggaccccaagaccggcaagtccctgcgcggccggtacttcgacttctgggggcgcggcaccggggtgaccgtgagcccc

SEQ ID NO: 12071 - RNA, 390 nt, synthetic construct
  misc_feature 1..390: note = derived and/or modified sequence opt1 from anti-HIV_Chain
  source 1..390: mol_type = other RNA
cagatcgagctgcgccagagcggcgccgccatgaagtcccccgggagctccgtgaagctcagctgcaccgtcctgggcgagaacttcgggacctacttcatctcctggatccggcaggcgccgggccaggggctggagtgggtgggcggcatcgtgccccacagccagctccagtccagcgcccagaagttccacgggcgcatcaagatctccggcgggggcacgccgcccgtcgtgagcctggagctgaccaacgtgaccttcgacgacaccgggacgtacttctgcgcccgggagcgcggccggcacgtcgagcccaagaccggcgaccgcctcgccgggcggtacttcgacatctggggccgcgggaccggcctgcgggtgtccccc

SEQ ID NO: 12072 - RNA, 390 nt, synthetic construct
  misc_feature 1..390: note = derived and/or modified sequence opt1 from anti-HIV_Chain
  source 1..390: mol_type = other RNA
gaggtgcagctggtcgagagcggcgggggcctcgtgaagcccgggggctccctgcgcctgagctgcgaggcctccgggttcaccttcaccaacgcctggatgaactgggtgcggcaggcgccgggcaagggcctcgagtgggtcgggcgcatcaagagccagacgcacggcgggaccacccggtacgccgcccccgtgaagggccgcttcaccatctcccgggacgacagcaagcacacgctgtacctgcagatggaccgcctcaccaccgaggacaccgccgtgtactactgcacggggaccatcaccggctccaccttctactactacggcatggacgtctgggggcagggcacgaccgtgaccgtgagccccgcctccaccaagggg

SEQ ID NO: 12073 - RNA, 390 nt, synthetic construct
  misc_feature 1..390: note = derived and/or modified sequence opt1 from anti-HIV_Chain
  source 1..390: mol_type = other RNA
gtggtccagctggtgcagagcggccccgggctcgtgaagccctcccagaccctgagcctgacctgcacggtctccggcgggagcatctccagcggcgacttctactggtcctggatccgccagccgcccgggaagggcctcgagtggatcggctacatctactacagcgggtccacctactacaaccccagcctgaagtcccggctgaccatcagcgtggacacctccaagaaccagttcagcctccgcctgtccagcgtgacggccgccgacaccgcggtctactactgcgcccgggacctgaactcccgcatcgtgggcgccctcgacgccttcgacatctgggggcagggcaccatggtgaccgtcagctccgccagcacgaagggg

SEQ ID NO: 12074 - RNA, 390 nt, synthetic construct
  misc_feature 1..390: note = derived and/or modified sequence opt1 from anti-HIV_Chain
  source 1..390: mol_type = other RNA
gaggtgcagctggtccagagcggcgggggcctcgtgcagcccgggcgctccctgcggctgagctgcgccgcctccggcttcaccttcgacgactacgcgatgcactgggtgcgccaggccccggggaagggcctcgagtgggtcagcggcatctcctggaacagcgggaccatcggctacgccgactccgtgcgggggcgcttcacgatcagccgggacgacgccaagtccagcctgtacctgcagatgaactccctccgcaccgaggacaccgccctgtactactgcgcgaaggacggctgggtggggagcggctccagcaccctgcggggctccgactactgggggcagggcacgctcgtcaccgtgagctccgccagcaccaagggg

SEQ ID NO: 12075 - RNA, 390 nt, synthetic construct
  misc_feature 1..390: note = derived and/or modified sequence opt1 from anti-HIV_Chain
  source 1..390: mol_type = other RNA
cagagcgtgctgacccagccgccctccgccagcggctcccccgggcagagcatcaccatctcctgcacgggcaccagctccgacgtcgggggctacaactacgtgagctggtaccagcagccgcccgggaaggcccccaaggtgatcatctacgaggtctccaagcgccccagcggcgtgcccgaccggttctccggcagcaagtccgggaacaccgcgagcctcaccgtgtccggcctgcaggccgaggacgaggccgactactactgcagctcctacgccgggagcaacaacttcgtcttcggcacggggaccgaggtgaccgtggtcggccagcccaaggccaaccccaccgtgacgctgttcccgccctccagcgaggagctcctg

SEQ ID NO: 12076 - RNA, 390 nt, synthetic construct
  misc_feature 1..390: note = derived and/or modified sequence opt1 from anti-HIV_Chain
  source 1..390: mol_type = other RNA
caggccgtggtcacccaggagcccagcctgaccgtgtcccccggcgggacggtgaccctgacctgcgccagctccaccggcgcggtcacgagcgggttctacccccactggttccagcagaagcccggccaggcgccccgcgccctcatctactccaccagcaaccggtactcctggaccccggcccgcttcagcgggtccctgctcggcggcaaggccgccctgaccctgagcggggtgcagcccgaggacgaggccgagtactactgcctcctgctgccctactacggcgggccctggatcttcggcgggggcacgaagctcaccgtgctgggccagccgaaggccgccccctccgtcaccctgttcccgcccagctccgaggagctc

SEQ ID NO: 12077 - RNA, 390 nt, synthetic construct
  misc_feature 1..390: note = derived and/or modified sequence opt1 from anti-HIV_Chain
  source 1..390: mol_type = other RNA
cagagcgccctgacccagcccccgtccgccagcggcgcgcccgggcagcgcgtgaccatctcctgcagcggcgggccctccaacgtcggcgggaactacgtgtactggtaccggcagttccccggcacggcccccaccctcctgatcctgcgcgacgaccagcggcccagcggcgtgcccgaccgcttctccgccagcaagtccgggaacagcgcctccctcgccatcagcggcctgcggcccgacgacgaggggttctacttctgcgcgacctacgactccgacggcagcatccgcctgttcgggggcggcaccgccctcacggtcctgtcccagccgaaggccgcccccagcgtgaccctgttcccgccctccagcgaggagctcaag

SEQ ID NO: 12078 - RNA, 390 nt, synthetic construct
  misc_feature 1..390: note = derived and/or modified sequence opt1 from anti-HIV_Chain
  source 1..390: mol_type = other RNA
caggtgcagctggtcgagagcggctccgacgtgcgcaagcccggggccaccgtgaccgtcagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagcgcgtccaccaagggc

SEQ ID NO: 12079 - RNA, 390 nt, synthetic construct
  misc_feature 1..390: note = derived and/or modified sequence opt1 from anti-HIV_Chain
  source 1..390: mol_type = other RNA
gaggtgcagctggtcgagagcggctccgacgtgcgcaagcccggggccaccgtgaccgtcagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagcgcgtccaccaagggc

SEQ ID NO: 12080 - RNA, 390 nt, synthetic construct
  misc_feature 1..390: note = derived and/or modified sequence opt1 from anti-HIV_Chain
  source 1..390: mol_type = other RNA
gaggtgcagctggtccagagcggctccgacgtgcgcaagcccggggccaccgtgaccgtcagctgcaaggccgacgaggacgaggacgacttcacggcgtacgactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagcgcgtccaccaagggc

SEQ ID NO: 12081 - RNA, 390 nt, synthetic construct
  misc_feature 1..390: note = derived and/or modified sequence opt1 from anti-HIV_Chain
  source 1..390: mol_type = other RNA
caggtgcagctggtccagagcggctccgacgtgcgcaagcccggggccaccgtgaccgtcagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagcgcgtccaccaagggc

SEQ ID NO: 12082 - RNA, 390 nt, synthetic construct
  misc_feature 1..390: note = derived and/or modified sequence opt1 from anti-HIV_Chain
  source 1..390: mol_type = other RNA
caggtgcagctggtccagagcggctccgacgtgcgcaagcccggggccaccgtgaccgtcagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcccggggccgcgggaccagcctcaccgtgtccagcgcgtccaccaagggc

SEQ ID NO: 12083 - RNA, 390 nt, synthetic construct
  misc_feature 1..390: note = derived and/or modified sequence opt1 from anti-HIV_Chain
  source 1..390: mol_type = other RNA
gaggtgcagctggtcgagagcggctccgacgtgcgcaagcccggggccaccgtgaccgtcagctgcaaggccgacgaggacgaggacgacttcacggcgtacaactacttcatgcactgggtgcggcaggccccgggccaggggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagcgcgtccaccaagggc

SEQ ID NO: 12084 - RNA, 390 nt, synthetic construct
  misc_feature 1..390: note = derived and/or modified sequence opt1 from anti-HIV_Chain
  source 1..390: mol_type = other RNA
gtggtccagctggtgcagagcggctccgacgtgcgcaagcccggggccaccgtcaccgtgagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtcaccctgacccgcgagcggtccacgagcaccgtgttcatgaagctgaccaacctccgcctggacgacaccgccgtgtacttctgcgcccggcccctgcgcggcggggacacgtggcactaccactcctggggccgggggaccagcctcaccgtctccagcgcgtccaccaagggc

SEQ ID NO: 12085 - RNA, 390 nt, synthetic construct
  misc_feature 1..390: note = derived and/or modified sequence opt1 from anti-HIV_Chain
  source 1..390: mol_type = other RNA
gaggtgcagctggtccagagcggctccgacgtgcgcaagcccggggccaccgtgaccgtcagctgcaaggccgacgaggacgaggacgacttcacggcgtacaactacttcatgcactgggtgcggcaggccccgggccacgggctcgagtggatcggctggatcaacccccgcaccgggcagcccaaccacgccaagcagttccagggccgggtgaccctgacccgcgagcggtccacgagcaccgtcttcatgaagctgaccaacctccgcctggacgacaccgccgtgtacttctgcgcccggcccctgcgcggcggggacacgtggcactaccactcctggggccgggggaccagcctcaccgtgtccagcgcgtccaccaagggc

SEQ ID NO: 12086 - RNA, 390 nt, synthetic construct
  misc_feature 1..390: note = derived and/or modified sequence opt1 from anti-HIV_Chain
  source 1..390: mol_type = other RNA
gaggtgcagctggtccagagcggctccgacgtgaagaagcccgggaccaccgtgacgatcagctgcaaggccgacgaggacgaggacgacttcaccgcctacaactacttcatgcactgggtccgccaggcgccgggccaggggctcgagtggatcggctggatcaacccccggaccgggcagcccaaccacgccaagcagctgcagggccgcgtgaccctgacgcgggagcgctccaccagcaccgtgttcatgaagctcaccaacctgcggctggacgacacggccgtctacttctgcgcccgccccctccggggcggggacacctggcactaccactcctggggccgcgggaccagcctgatcgtgtccagcgcctccaccaagggc

SEQ ID NO: 12087 - RNA, 390 nt, synthetic construct
  misc_feature 1..390: note = derived and/or modified sequence opt1 from anti-HIV_Chain
  source 1..390: mol_type = other RNA
caggtgcagctggtcgagagcggcgggggcctcgtgaagcccgggggctccctgcgcctgagctgcgccgcctccgggttcagcttcaacgagtactacatgtcctggatccggcaggcgccgggccagggcctcgagtgggtggccaacatcgggagctccgacgcctacaccatctacgccgacagcgtcaagggccgcttcaccatctcccgggacaacgccgagaacacggtgtacctgcagatgaacagcctgcgcggggaggacaccgcggtgtactactgcgcccggatcgagggctactgctccaacagccgctgctccaactacttcgacccctgggggcagggcgccctcgtcaccgtgagctccgccagcaccaagggc

SEQ ID NO: 12088 - RNA, 390 nt, synthetic construct
  misc_feature 1..390: note = derived and/or modified sequence opt1 from anti-HIV_Chain
  source 1..390: mol_type = other RNA
caggtgcagctggtccagagcggcgccgaggtgaagaagcccggggcctccgtgaaggtcagctgcaaggtgtccggctacccgctcgcggagctgagcgtgcactgggtccgccaggtgcccgggaagggcctggagtgggtcgggggcttcgaccccgaggagggcaagaccgtgtacgcccagaagttccaggggcgggtgaccatgacggaggaccgctccaccgacaccgtgtacatggagctcatcagcctgcggtacgaggacaccgccgtctactactgcgccacggacaaccccgtgctgcagctcggcgagctgtccagctccctggactactgggggcagggcaccctcgtgaccgtcagctccgccagcaccaagggg

SEQ ID NO: 12089 - RNA, 390 nt, synthetic construct
  misc_feature 1..390: note = derived and/or modified sequence opt1 from anti-HIV_Chain
  source 1..390: mol_type = other RNA
gaggtgcagctggtccagagcggcgccgaggtgaagaagcccggggagtccctccgcatcagctgcaagacctccggctacaacttcaacgacgactggatcgcctgggtgcggcagcgcccggacaaggggcccgagtggatgggcatcttctaccccggggacagccaggcgacctactcccccagcttccagggccacgtcacgttctccgccgacaccagcatctccaccgcctacctgcagtggaccagcctgaaggcctccgacacggccatctactactgcgcgcggacccgctgcttcggcgccaactgcttcaacttcatggacgtgtgggggaagggcaccgccctcaccgtgacggtcagctccgccagcaccaagggg

SEQ ID NO: 12090 - RNA, 390 nt, synthetic construct
  misc_feature 1..390: note = derived and/or modified sequence opt1 from anti-HIV_Chain
  source 1..390: mol_type = other RNA
caggtgcagctggtccagctcctgcagagcggcgccgaggtgaagaagcccgggtccagcgtgaaggtctcctgccagatcagcggctacgggttctccaactacgccatcagctgggtgcgccaggcgccgggccaggggctggagtggctcggccggatcgtgcccgccgtcggcatgaccgagtacgcccagaagttccaggggcgcgtgaccttcacggccgaccggtccaccatcaccgcctacatggacctgcgcggcctgcggagcgacgacaccgcggtgtactactgcgtccgcgacccccaggtggaggtgcgggggaacgccttcgacatctggggccaggggacgatggtcaccgtgtccagcgcctccaccaagggc

SEQ ID NO: 12091 - RNA, 390 nt, synthetic construct
  misc_feature 1..390: note = derived and/or modified sequence opt1 from anti-HIV_Chain
  source 1..390: mol_type = other RNA
caggtgcacctccagcagtggggcgccgggctcctgaagcccagcgagaccctgtccctgacctgcgccgtcagcggcgggtccttcagcggcttcttctggacgtggatccgccagtccccggggaagggcctggagtggatcggcgaggtgaaccacagcgggttcacccactccaaccccagcctggagtcccgggcgaccatcagcgtggccgcctccaacacccagttcagcctccgcctggcctccgtcacggccgcggacaccgccatctacttctgcgccctgcggtacttcgactggagccccttccgccgggacacctacggcaccgacgtgtgggggcagggcacgaccgtgatcgtctccagcgcctccaccaagggg

SEQ ID NO: 12092 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcggggccctccggaagcccggcgcctccgtcaccctgagctgccaggcgtccgggtacaacttcgtgaagtacatcatccactgggtgcgccagcggccgggcctggggttcgagtgggtcggcatgatcgacccctaccgcggccggccctggtacgcccacagcttcgccgggcgcctctccctgagccgggacacctccacggagaccctgtacatgaccctcagctccctcaagagcgacgacaccgccacgtacttctgcgcccgcgcggaggccgcctccgacagccactcccggcccatcatggactggacctggcgcatcctgtgcctgctggccgtggtgccggcgagcaccaagggc

SEQ ID NO: 12093 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccgtccggaagcccggggcgtccgtgaccctcagctgccaggcctccggctacaacttcgtgaactacatcatccactgggtccgccagcggccggggctggacttcgagtgggtgggcatgatcgacccctaccgcgggcggccctggagcgcccacaagttccagggccgcctgtccctcagccgggacgtgtccaccgagatcctgtacatgacgctgaacagcctccgctccgacgacaccgccacctacttctgcgcccgggcggaggccgagagccagtcccacagccgccccatcatgttcgactcctggggccaggggagccgggtcaccgtgtccagcgcctccacgaagggc

SEQ ID NO: 12094 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccgtcaagaagcccggggcgtccgtgaccatcagctgccaggcctccggctacaacttcgtgaagttcttcatccactgggtccggcagcgcccggggcagggcttcgagtgggtggggatgatcgagccctaccggggccgcccctggagcgccggcaacttccaggggcggctctccctgagccgcgacgtgtccaccgagacgctgtacatgaccctcaacaacctgcggagcgacgacaccgccgtctacttctgcgcccgcctggaggcggagtccgacagccactcccggcccatcatgttcgaccactggggccacgggagcctcgtgaccgtgtccagcgcctccacgaagggc

SEQ ID NO: 12095 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccgtccggaagcccggggcgtccgtgaccctcagctgccaggcctccggctacaacttcgtgaactacatcatccactgggtccgccagcggccggggctggacttcgagtgggtgggcatgatcgacccctaccgcgggcggccctggagcgcccacaagttcgagggccgcctgtccctcagccgggacgtgtccaccgaggtcctgtacatgacgctgagctccctccgcagcgacgacaccgccacctacttctgcgcccgggcggaggccgagtcccagagccactcccgccccatcatgttcgactactggggccaggggagccgggtgaccgtgtccagcgcctccacgaagggc

SEQ ID NO: 12096 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcaccgccgtccggaagcccggggcctccgtgaccatcagctgccaggcgtccggctacaacttcgtgaagttcttcatccacggggtccgccagcggccgggccaggggttcgagtgggtgggcatgatcgagcccttccgcggccggccctggagcgccgggaacttccagggccgcctctccctgagccgggacgtgtccacggagaccctgtacatgaccctcaacaacctgcgcagcgacgacaccgccgtctacttctgcgcccggctggaggccgagtccgacagccactcccgccccatcatgttcgaccactgggggcacggcagcctcgtgacggtgtccagcgcgtccaccaagggg

SEQ ID NO: 12097 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcaccgccatgcggaagcccggggcctccgtcaccctcagctgccaggcgtccggctacaacttcgtgaagtacatcgtgcactgggtccgccagaagccggggctgggcttcgagtgggtggggatgatcgacccctaccggggccgcccctggagcgcccacaagttccagggccggctgtccctcagccgcgacacgtccatggagatcctgtacatgaccctgaccagcctcaagtccgacgacaccgccacgtacttctgcgcccgggccgaggcggccagcgactcccacagccgccccatcatgttcgaccactgggggcagggctcccgggtgaccgtcagctccgccagcaccaagggg

SEQ ID NO: 12098 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccatgcggaagcccggggcgtccgtcaccctcagctgccaggcctccggctacaacttcgtgaagtacatcgtgcactgggtccgccagaagccggggctgggcttcgagtgggtggggatgatcgacccctaccggggccgcccctggagcgcccacaagttccagggccggctgtccctcagccgcgacacctccatggagatcctgtacatgacgctgaccagcctcaagtccgacgacaccgccacctacttctgcgcccgggcggaggccgccagcgactcccacagccgccccatcatgttcgaccactgggggcagggctcccgggtgacggtcagctccgccagcaccaagggg

SEQ ID NO: 12099 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccatgcggaagcccggggcgtccgtcaccctcagctgccaggcctccggctacaacttcgtgaagtacatcatccactgggtgcgccagaagccggggctgggcttcgagtgggtcgggatgatcgacccctaccggggccgcccctggagcgcccacaagttccagggccggctgtccctcagccgcgacacctccatggagatcctgtacatgacgctgaccagcctcaagtccgacgacaccgccacctacttctgcgcccgggcggaggccgccagcgactcccacagccgccccatcatgttcgaccactgggggcagggctcccgggtgacggtgagctccgccagcaccaagggg

SEQ ID NO: 12100 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcaacgccgtccggaagcccggggcctccgtgaccatcagctgccaggcgtccggctacaacttcgtgaagttcttcatccactgggtccgccagcggccggggcagggcttcgagtgggtggggatgatcgagcccttccgcggccggccctggagcgccggcaacttccaggggcgcctctccctgagccgggacgtgtccaccgagacgctgtacatgaccctcaacaacctgcgcagcgacgacaccgccgtctacttctgcgcccggctggaggccgagtccgacagccactcccgccccatcatgttcgaccactggggccacgggagcctcgtgaccgtgtccagcgcgtccacgaagggc

SEQ ID NO: 12101 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccgtccggaagcccggggcgtccgtgaccctcagctgccaggcctccggctacaacttcgtgcgctacatcatccactgggtccggcagcgcccggggctggacttcgagtgggtgggcatgatcgacccctaccgggggcgcccctggagcgcccacaagttcggcggccggctgtccctcacccgcgacgtgagcacggagatcctgtacatgaccctgacctccctccggagcgacgacaccgccacgtacttctgcgcccgcgcggaggccgagtcccagagccactcccggcccatcatgttcgacagctgggggcagggctcccgcgtcaccgtgagctccgccagcaccaagggg

SEQ ID NO: 12102 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccgtccggaagcccggggcgtccgtgaccctcagctgccaggcctccggctacaacttcgtgaactacatcatccactgggtccgccagcggccggggctggacttcgagtgggtgggcatgatcgacccctaccgcgggcggccctggagcgcccacaagttccagggccgcctgtccctcagccgggacgtgtccaccgagatcctgtacatgacgctgagctccctccgcagcgacgacaccgccacctacttctgcgcccgggcggaggccgagtcccagagccactcccgccccatcatgttcgacttctggggccaggggagccgggtcaccgtgtccagcgcctccacgaagggc

SEQ ID NO: 12103 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcaccgccgtccggaagcccggggcctccgtgaccatcagctgccaggcgtccggctacaacttcgtgaagttcttcatccactgggtccgccagcggccggggcagggcttcgagtgggtggggatgatcgagcccttccgcggccggccctggagcgccggcaacttccaggggcgcctctccctgagccgggacgtgtccacggagaccctgtacatgaccctcaacaacctgcgcagcgacgacaccgccgtctacttctgcgcccggctggaggccgagtccgacagccactcccgccccatcatgttcgaccactggggccacgggagcctcgtgacggtgtccagcgcgtccaccaagggc

SEQ ID NO: 12104 - RNA, 390 nt, synthetic construct
  misc_feature 1..390: note = derived and/or modified sequence opt1 from anti-HIV_Chain
  source 1..390: mol_type = other RNA
caggtgcgcctggagcagagcggcgccgccatgcggaagcccggggcgtccgtcaccctcagctgccaggcctccggctacaacttcgtgaagtacatcgtgcactgggtccgccagaagccggggctgggcttcgagtgggtggggatgatcgacccctaccggggccgcccctggagcgcccacaagttccagggccggctgtccctcagccgcgacacctccatggagatcctgtacatgacgctgaccagcctcacctccgacgacaccgccacgtacttctgcgcccgggcggaggccgccagcgactcccacagccgccccatcatgttcgaccactgggggcagggctcccgggtgaccgtcagctccgccagcaccaagggg

SEQ ID NO: 12105 - RNA, 390 nt, synthetic construct
  misc_feature 1..390: note = derived and/or modified sequence opt1 from anti-HIV_Chain
  source 1..390: mol_type = other RNA
gaggtgcagctggtccagagcggcgggggcctcgtgcagcccgggggctccctgcggctgagctgcgccgcctccgggctcaccttccggaacttcgcgatgagctgggtgcgccaggccccgggcaagggcctggagtgggtctccagcatctccgggagcggcgggtccacctactacgccgacagcgtgaagggccggttcacgatctcccgcgacaacagcaagaacaccctgtacctccagatgaactccctgcgcggggaggacaccgccgtgtacttctgcgccaagggcgtcggctacgacatcctgaccgggctcggcgacgcgttcgacatctgggggcagggcacggtggtggccgtcagctccgccagcaccaagggc

SEQ ID NO: 12106 - RNA, 393 nt, synthetic construct
  misc_feature 1..393: note = derived and/or modified sequence opt1 from anti-HIV_Chain
  source 1..393: mol_type = other RNA
caggtgcagctggtccagagcggcgccgccgtgcgcaagcccggggcgtccgtgaccgtcagctgcaagttcgccgaggacgacgactactccccgcactgggtgaaccccgcccccgagcactacatccacttcctccggcaggcccccggccagcagctggagtggctggcctggatgaacccgaccaacggggcggtgaactacgcctggcagctccacggccgcctgacggccacccgggacgggagcatgaccaccgccttcctggaggtccgctccctccggagcgacgacacggcggtgtactactgcgcccgcgcccagaagcggggccgctccgagtgggcctacgcccactggggccaggggacccccgtgctggtcagctcc

SEQ ID NO: 12107 - RNA, 393 nt, synthetic construct
  misc_feature 1..393: note = derived and/or modified sequence opt1 from anti-HIV_Chain
  source 1..393: mol_type = other RNA
caggtgcagctgcagcagtggggcgccgggctcctgaagcccagcgagaccctgtccctgacctgcgccgtctacgcgggcagcttctccgggtactactggacgtggatccgccagccgcccggcaaggggctggagtggatcggcgaggtgaaccacggcgggagcaccaactacaacccctccctcaagagccgggtgaccctctccgtcgacaccagcaagaaccagttctccctgaagctgacgagcgtgaccgccgccgacaccgccgtgtactactgcgcccgcgtctcccggtacgacttctggagcggcaactacgggtcctacggcctcgacgtgtgggggcagggcaccacggtgaccgtcagctccgcgagcaccaagggc

SEQ ID NO: 12108 - RNA, 393 nt, synthetic construct
  misc_feature 1..393: note = derived and/or modified sequence opt1 from anti-HIV_Chain
  source 1..393: mol_type = other RNA
gaggtgcagctggtccagagcggcgggggcgtggtgcagcccgggcgctccctccggctgagctgcgtcgtgtccggcttcaccttcagctccttcaccttccactgggtgcgccaggccccggggaagggcctggagtgggtcgccggcatgagcttccacgcgacgtacatctactacgccgactccgtgaaggggcggttcaccatcagccgcgacgactcccaggacaccctctacctggagatggacagcctgcggtccgaggacaccgccatctactactgcgcccgcgaccccggcatccacgactacggggactacgcccccggcgcgttcgactactgggggcagggcagccccgtgacggtctccagcgcctccaccaagggc

SEQ ID NO: 12109 - RNA, 393 nt, synthetic construct
  misc_feature 1..393: note = derived and/or modified sequence opt1 from anti-HIV_Chain
  source 1..393: mol_type = other RNA
caggtgcagctggtccagagcggcaccgaggtgcagaagcccggggcctccgtgaaggtcagctgcaagacctccggctacacgttcagcaagtactacatccactgggtgcgccaggcccccgggcagggcctcgagtgggtggggcggatcaacaccgactccggcggcaccgactacgcggagaagttccaggggcgcgtcaccatgacgcgggacaccagcatcaccaccgtgtacctggagatgcgcggcctgacgtccgacgacaccgccgccttctactgcgcccgggggccgccccacgccggcgggtggaccatctactactacggcctcgacgtgtggggccaggggaccagcgtcatcgtgtccagcgcgtccacgaagggc

SEQ ID NO: 12110 - RNA, 393 nt, synthetic construct
  misc_feature 1..393: note = derived and/or modified sequence opt1 from anti-HIV_Chain
  source 1..393: mol_type = other RNA
cgcaccgtggtcacccagcccccgagcgtgtccggcgcccccgggcagcgggtgacgatcagctgcaccggctccagctccaacatcggggccggctacgacgtccactggtaccagcagctgcccgggaccgcgcccaagctcctgatctacggcaacagcaaccgcccgtccggcgtgcccgaccggttcagcgggtccaagagcggcacctccgccagcctggccatcacggggctccaggccgaggacgaggccgactactactgccagtcctacgacagctccctgagcggctccggggtgttcggcaccggcaccaaggtcaccgtgctggggcagcccaaggcgaaccccacggtgaccctcttcccgcccagctccgaggagctg

SEQ ID NO: 12111 - RNA, 393 nt, synthetic construct
  misc_feature 1..393: note = derived and/or modified sequence opt1 from anti-HIV_Chain
  source 1..393: mol_type = other RNA
caggtgcagctgcagcagtggggcagcgggctcctgaagccctccgagaccctgagcctgacctgcgccgtctacggcgggtccttccgcagctactactggaactggatccggcagtccccgggcaaggggctcgagtggatcggcgaggtgagccactccggcagcacgaactacaaccccgccctgaagtcccgcgtgaccatcagcgtcgacacctccaagaaccagttcagcctcaaggtgaagtccgtgaccgcggccgacacggccctgtactactgcagccgggggcgcggcaagcggtgctccggggcctactgcttcgccggctacttcgacagctgggggcagggcggcctggtcgtggtgtccagcgcgtccaccaagggg

SEQ ID NO: 12112 - RNA, 393 nt, synthetic construct
  misc_feature 1..393: note = derived and/or modified sequence opt1 from anti-HIV_Chain
  source 1..393: mol_type = other RNA
caggtgcacctggtccagagcggcgccgaggtgaagaagcccgggtccagcgtgcgcgtctcctgcgaggccagcggctggaccttcgggtccgtgaacagcgcgatcacctgggtgcggcaggccccgggccaggggctcgagtggatgggccgcacgatccccttcctgggcatctccaactacgcccagaagttccaggggcgggtcaccatcaccgccgacaagagcaccaacatcgcctacgtggacgtgacgtccctgaccagccaggacaccgcggtctactactgcgcccgcctcatcaccggcatgacggccccctggttctactacatggacgtgtgggggaagggcaccaccgtgaccgtctccagcgcctccacgaagggg

SEQ ID NO: 12113 - RNA, 393 nt, synthetic construct
  misc_feature 1..393: note = derived and/or modified sequence opt1 from anti-HIV_Chain
  source 1..393: mol_type = other RNA
caggtgcacctccaggagagcggcccccgcctggtccggtccagcgagaccctgtccctgacctgcagcgtgcccgggggctccatcgtgaaccccatcacgaactactactggagctggatccgccagtccccgcggaaggggctccagtggatcggcgacatctactacaccgggaccagctcccgcaaccccagcctggactcccgggtcagcatctccatggacgtgagccgcaagcagatctccctgaccctctacagcgtgacggccgccgacaccgcggtccactactgcgcctcccagagcctgtcctggtaccggccgagcggctacttcgagagctggggccaggggatcctggtgaccgtgtccagcgcctccaccaagggc

SEQ ID NO: 12114 - RNA, 393 nt, synthetic construct
  misc_feature 1..393: note = derived and/or modified sequence opt1 from anti-HIV_LightChain
  source 1..393: mol_type = other RNA
atgaagctgcccgtgcgcctcctggtcctgatgttctggatcccggccagctccagcgacatcgtgatgacccagagccccctctccctgcccgtgacccccggcgagccggcctccatcagctgccggtccagccagcgcctgctctccagctacgggcacacgtacctgcactggtacctgcagaagcccggccagagcccccagctcctgatctacgaggtctccaaccggttctccggggtgcccgaccgcttcagcggctccgggagcggcaccgacttcaccctgaagatctcccgggtggaggcggaggacgtcggcgtgtactactgcagccagtccacccacgtgccgctcacgttcgggcagggcaccaaggtcgagatcaag

SEQ ID NO: 12115 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgtccgagaccctgagcgtgacctgctccgtgagcggcgactccatgaacaactactactggacgtggatccgccagagccccgggaagggcctggagtggatcgggtacatctccgaccgggccagcgccacctacaacccctccctcaacagccgcgtcgtgatctcccgggacaccagcaagaaccagctgtccctgaagctcaacagcgtgacccccgcggacacggccgtctactactgcgccaccgcccgccggggccagcgcatctacggcgtggtgtccttcggggagttcttctactactacagcatggacgtctggggcaaggggaccaccgtgacggtgtccagc

SEQ ID NO: 12116 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgcccgagaccctgtccctgacctgcagcgtgtccggcgccagcgtgaacgacgcctactggtcctggatccgccagagccccgggaagcggcccgagtgggtcggctacgtgcaccactccggggacacgaactacaacccgagcctcaagcgccgggtgaccttctccctggacaccgcgaagaacgaggtcagcctgaagctcgtggccctgaccgccgccgactccgccgtgtacttctgcgcgcgcgccctgcacggcaagcggatctacggcatcgtcgccctcggggagctgttcacgtacttctacatggacgtgtggggcaaggggaccaccgtgaccgtcagctcc

SEQ ID NO: 12117 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgtccgagaccctgagcctgacctgctccgtgagcggcgcctccatcagcgactcctactggagctggatccgccggtcccccgggaagggcctcgagtggatcgggtacgtgcacaagagcggcgacacgaactactcccccagcctgaagtcccgcgtcaacctgagcctcgacacctccaagaaccaggtgagcctgtccctggtggccgcgaccgccgccgacagcggcaagtactactgcgcccggaccctccacgggcgccggatctacggcatcgtcgccttcaacgagtggttcacgtacttctacatggacgtgtgggggaacggcacccaggtgaccgtctccagc

SEQ ID NO: 12118 - RNA, 396 nt, synthetic construct
  misc_feature 1..396: note = derived and/or modified sequence opt1 from anti-HIV_Chain
  source 1..396: mol_type = other RNA
caggtgcacctccaggagagcggccccgggctggtcaagccgtccgagaccctgagcctgacctgcaacgtgtccggcacgctcgtgcgcgacaactactggagctggatgcggcagcccctggggaagcagcccgagtggatcggctacgtccacgactccggggacaccaactacaaccccagcctgaagtcccgcgtgcacctcagcctggacaagtccaacaacctggtgagcctccggctgaccgccgtcaccgccgcggactccgccacgtactactgcgccaccaccaagcacggccgccggatctacggcatcgtggccttcaacgagtggttcacctacttctacatggacgtgtgggggaagggcacgaccgtcaccgtgagctcc

SEQ ID NO: 12119 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgtccgagaccctgagcgtgacctgctccgtgagcggcgactccatgaacaactactactggacgtggatccgccagagccccgggaagggcctggagtggatcgggtacatctccgaccgggagagcgccacctacaacccctccctcaacagccgcgtcgtgatctcccgggacaccagcaccaaccagctgtccctgaagctcaacagcgtgacgcccgccgacaccgcggtctactactgcgccaccgcccgccggggccagcgcatctacggcgtggtgtccttcggggagttcttctactactacagcatggacgtctggggccgggggaccacggtgaccgtgtccagc

SEQ ID NO: 12120 - RNA, 396 nt, synthetic construct
  misc_feature 1..396: note = derived and/or modified sequence opt1 from anti-HIV_Chain
  source 1..396: mol_type = other RNA
caggtgcagctggtcgagagcggccccgggctggtgaccccgtccgagaccctgagcctgacgtgcaccgtgtccaacggcagcgtctccgggcgcttctggagctggatccggcagtcccccggccgcgggctcgagtggatcggctacttcagcgacaccgaccggtccgagtacagcccctccctgcgcagccggctgaccctctccctggacgccagccgcaaccagctgtccctcaagctcaagagcgtgacggccgcggactccgccacctactactgcgcccgggcccagcagggcaagcgcatctacgggatcgtgagcttcggcgagttcttctactactactacatggacgcctgggggaagggcaccgcggtcaccgtgtccagc

SEQ ID NO: 12121 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgcccgagaccctgtccctgacctgcagcgtgtccggcgccagcatcaacgacgcctactggtcctggatccgccagagccccgggaagcggcccgagtgggtgggctacgtccaccactccggggacacgaactacaacccgagcctcaagcgccgggtgaccttctccctggacaccgcgaagaacgaggtgagcctgaagctcgtcgacctgaccgccgccgactccgccgtgtacttctgcgcccgcgcgctgcacggcaagcggatctacggcatcgtggccctcggggagctgttcacgtacttctacatggacgtctggggcaaggggaccaccgtgaccgtgagctcc

SEQ ID NO: 12122 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgcccgagaccctgtccctgacctgcagcgtgtccggcgccagcatcaacgacgcctactggtcctggatccgccagagccccgggaagcggcccgagtgggtgggctacgtccaccactccggggacacgaactacaacccgagcctcaagcgccgggtgtccttcagcctggacaccgcgaagaacgaggtgtccctgaagctcgtcgacctgaccgccgccgacagcgccatctacttctgcgcccgcgcgctgcacggcaagcggatctacggcatcgtggccctcggggagctgttcacctacttctacatggacgtgtggggcaaggggacgaccgtcaccgtgtccagc

SEQ ID NO: 12123 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgtccgagaccctgagcgtgacctgctccgtgagcggcgactccatgaacaacagctactggacgtggatccgccagtcccccgggaagggcctggagtggatcgggtacatcagcaagtccgagagcgccaactacaacccctccctcaacagccgggtcgtgatctcccgcgacaccagcaagaaccagctgtccctgaagctcaacagcgtgacccccgccgacaccgcggtctactactgcgccacggcccggcacggccagcgcatctacggcgtggtgtccttcggggagttcttcacctactacagcatggacgtctggggcaaggggaccaccgtgacggtgtccagc

SEQ ID NO: 12124 - RNA, 396 nt, synthetic construct
  misc_feature 1..396: note = derived and/or modified sequence opt1 from anti-HIV_Chain
  source 1..396: mol_type = other RNA
caggtgcagctgcaggagagcggccccgggctcgtcaagccgtccgagaccctgagcctgacctgctccgtgagcaacggctccgtgagcgggcgcttctggtcctggatccggcagagccccggccgcgggctcgagtggatcggctacttctccgacacggagaagtccaactacaaccccagcctgcggagccgcctgaccctctccgtcgacgccagcaagaaccagctgtccctgaagctcaacagcgtgaccgccgcggactccgccacctactactgcgcccggacgcagcagggcaagcgcatctacggggtggtcagcttcggcgagttcttccactactactacatggacgcctgggggaagggcaccgccgtgaccgtgtccagc

SEQ ID NO: 12125 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcaccgccctcaagtcccccgggagctccgccaagctgagctgcaccgtgctgggcgacgagttcgggacgtacttcatctcctggatccgccaggcgccgggccaggggctcgagtgggtgggcggcatcgtcccccacagccagctgcagtccagcgcccagaagttccacgggcggatcatcatctccgccggcgccggggtgaccccgcccgtggtcagcctgcagctcaccaacctgaccttcgaggacacgggcacctacttctgcgcccgcgagcgggggcgccaccgggaccccaagaccggcgacgcgctgcgcggccggtacttcgacttctgggggcgcggcaccggggtgtccgtgagcgcc

SEQ ID NO: 12126 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcaccgccctcaagtcccccgggagctccgccaagctgagctgcaccgtgctgggcgacgagttcgggacgtacttcatctcctggatccgccaggcgccgggccaggggctcgagtgggtgggcggcatcgtcccccacagccagctgcagtccagcgcccagaagttccacgggcggatcatcatctccgccggcgccggggtgaccccgcccgtggtcagcctgcagctcaccaacctgaccttcgaggacacgggcacctacttctgcgcccgcgagcgggggcgccaccgggaccccaagaccggcaaggcgccccgcggccggtacttcgacttctgggggcgcggcaccggggtgacggtgtccgcc

SEQ ID NO: 12127 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcaccgccctcaagtcccccgggagctccgccaagctgagctgcaccgtgctgggcgacgagttcgggacgtacttcatctcctggatccgccaggcgccgggccaggggctcgagtgggtgggcggcatcgtcccccacagccagctgcagtccagcgcccagaagttccacgggcggatcaccatctccgccggcgccggggtgaccccgcccgtggtcagcctgcagctcaccaacctgacgttcgaggacaccggcacctacttctgcgcccgcgagcgggggcgccaccgggaccccaagaccggcgacgcgctgcgcggccggtacttcgacttctgggggcgcggcacgggggtgcgggtgtccacc

SEQ ID NO: 12128 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcgccgccgtgaagtcccccgggagctccgcgaagctcagctgcaccgtgctgggcgacgagttcgggacctacttcatctcctggatccgccaggccccgggccaggggctggagtgggtcggcggcatcgtgccccacagccagctccagtccagcgcccagcggttccacgggcgcatcacgatctccgccggcgccggggtgaccccgcccgtcgtgagcctgcagctgaccaacctcaccttcgacgacgcgggcacgtacttctgcgcccgggagcgcgggcggcaccgcgaccccaagaccggcgacgccctgcggggccgctacttcgacttctgggggcggggcaccgggatctccgtgagcccc

SEQ ID NO: 12129 - RNA, 396 nt, synthetic construct
  misc_feature 1..396: note = derived and/or modified sequence opt1 from anti-HIV_Chain
  source 1..396: mol_type = other RNA
gaggtgcagctggtccagagcggcgccgaggtgaagaagcccggggcctccgtgaaggtcagctgcaaggtgtccggctacaccctcaccgagctgagcatccactgggtgcgccaggcgccggggaagggcctggagtggatgggcgggttcgaccccgaggacgacgaggccatctacgagcccaagttccagggccggctcacgatgaccgaggacacctccaccgacacggcctacatggagctgagctccctgcgcagcgaggacaccgccgtctactactgcgccaccgcggaccccttcaaggtggcccaggacgaggggctctacgtgatcttcgactactggggccaggggaccctggtcacggtgtccagcgcctccaccaagggc

SEQ ID NO: 12130 - RNA, 396 nt, synthetic construct
  misc_feature 1..396: note = derived and/or modified sequence opt1 from anti-HIV_Chain
  source 1..396: mol_type = other RNA
gaggtgcagctggtcgagagcggcgggggcctcctgcagcccgggggctccctgcgcctcagctgcgccgcctccgggttcagcttcaacgacttcgagatgaactgggtgcggcaggcgcccggcaagggcctggagtgggtgtcctacatcagcaacgacgggaccatgatccactacgccgactccgtcaagggccgcttcaccatcagccgggacaacgccaagaagtccctgttcctccagatgaacagcctgcgcgccgaggacacggccgtgtactactgcgcgcggctggccgaggtgccgcccgccatccgcgggtcctactactacggcatggacgtctgggggcagggcaccaccgtgaccgtggccagcgcgtccacgaagggc

SEQ ID NO: 12131 - RNA, 396 nt, synthetic construct
  misc_feature 1..396: note = derived and/or modified sequence opt1 from anti-HIV_Chain
  source 1..396: mol_type = other RNA
caggtgcagctgatgcagagcggcgccgaggtcaagcgccccggggcctccgtgaaggtgagctgcaaggcgttccggcactccctcaacaacctgggcatcagctggatccgccgggccccggggcgcggcctggagtggctcgggtggatcaacgtctacgagggcaacaccaagtacggccggcgcttccaggggcgggtgaccatgacgaccgaccgctccaccaacaccgtgagcatggagctgcggtccctgacgagcgacgacaccgccgtctactactgcgcccgcgacaaccacttctggtccggcagctcccggtactactacttcgggatggacgtgtggggccaggggaccaccgtgatcgtcagctccgccagcacgaagggc

SEQ ID NO: 12132 - RNA, 396 nt, synthetic construct
  misc_feature 1..396: note = derived and/or modified sequence opt1 from anti-HIV_Chain
  source 1..396: mol_type = other RNA
caggtgcagctggtccagtggggcgccgggctcctgaagcccctggagaccctcagcctgacctgcgccgtgtacggcgggtccttcaacggctacttctggagctggatccgccagacgccggggaagggcctggagtggatcggcgagatcaaccacgggggctccgcgaacttcaaccccagcctcaagtcccgggtgaccatgagcgtcgacacctccaagaaccagttcagcctgaagctggcctccgtgaccgccgccgacacggccatctactactgcgcgcgcgggcggatcaccatggtgcgcggcgacccccagcgcgggggcgtccggatggacgtgtggggccaggggaccagcgtgaccgtctccagcgcctccacgaagggc

SEQ ID NO: 12133 - RNA, 396 nt, synthetic construct
  misc_feature 1..396: note = derived and/or modified sequence opt1 from anti-HIV_Chain
  source 1..396: mol_type = other RNA
ctggtgcagctcgtccagagcggcgccgaggtgaagaagcccggggcctccgtgaaggtcagctgcaaggtgtccggccacaccctgagcgagctgtccatcaactgggtgcgccacgtcccggggaagggcctcgagtggatgggcgggctggaccccgaggacggcgaggcgatccacgagcccaagttccaggggcggctgaccatgacggaggacaccagcaccgacaccgcctactccacgctcagcgtgtgggcccccgtggccgccgcgatgtactactgcgccaccgccgacccgttcaaggtcgcccaggacgagggcctgtacgtgatcttcgactactgggggcagggcaccctggtgaccgtctccagcgcgtccacgaagggg

SEQ ID NO: 12134 - RNA, 396 nt, synthetic construct
  misc_feature 1..396: note = derived and/or modified sequence opt1 from anti-HIV_Chain
  source 1..396: mol_type = other RNA
caggtgcagctgctccagagcggcggggaggtcaagaagcccggcgcctccgtgaaggtgagctgcaaggtctccgggtacaccctgaccgagctgagcatccactgggtgcgccaggccccgggcaaggggctcgagtggatgggcggcttcgaccccgaggacgacgaggcgatctacgagcccaagttccaggggcggctgacgatgaccgaggacacctccaccgacacggcctacatggagctgagctccctccgcagcgaggacaccgccgtgtactactgcgccaccgccgaccccttcaaggtcgcgcaggacgagggcctgtacgtgatcttcgactactgggggcagggcaccctggtgacggtctccagcgcctccaccaagggg

SEQ ID NO: 12135 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcgccgaggtgaagaagcccggggcctccgtgaaggtcagctgcaaggtgtccggctacaccctcaccgagctgagcatccactgggtgcgccaggcgccggggaagggcctggagtggatgggcgggttcgactccgaggacggcgaggccttctacaagcagaacttccaggggcgggtcacgatgaccgaggacaccagcaccgacacggcctacatggagctccgccggctgcgctccgaggacaccgccgtgtactactgcgccaccgcggaccggttcaaggtggcccaggacgagggcctgttcgtcatcttcgactactgggggcagggcaccctcgtgacggtgagctccgccagcaccaagggg

SEQ ID NO: 12136 - RNA, 396 nt, synthetic construct
  misc_feature 1..396: note = derived and/or modified sequence opt1 from anti-HIV_Chain
  source 1..396: mol_type = other RNA
caggtgcacctggtccagagcggcgccgaggtgaagaagcccggggcctccgtgcgggtcagctgcaaggcgtccggctacaccttcaccacgtacgggatcagctgggtgcggcaggccccgggccaggggctcgagtggatgggctggatctccgcccacagcggcgacaccaactacgcccagaagctgcaggcccgcgtgaccatgaccacggacacctccaccaacaccgcgtacatggagctgcggagcctcacgtccgacgacaccgccgtctactactgcgcccgcgaccggccccgccactactacgaccgcgggggctactacagccccttcgactactgggggcagggcaccctggtgaccgtgtccagcgcctccacgaagggg

SEQ ID NO: 12137 - RNA, 396 nt, synthetic construct
  misc_feature 1..396: note = derived and/or modified sequence opt1 from anti-HIV_Chain
  source 1..396: mol_type = other RNA
ctggtgcagctcctgcagagcggcgccgaggtcaagaagcccggggcctccgtgaaggtgagctgcaaggtctccggctacaccctgaccgagctcagcatccactgggtgcgccaggcgccggggaagggcctggagtggatgggcgggttcgaccccgaggacgacgaggccatctacgagcccaagttccagggccggctgacgatgaccgaggacacctccaccgacacggcctacatggagctcagctccctgcgcagcgaggacaccgccgtgtactactgcgccaccgcggaccccttcaaggtcgcccaggacgaggggctgtacgtgatcttcgactactggggccaggggaccctcgtgacggtctccagcgcctccaccaagggc

SEQ ID NO: 12138 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcgccgaggtgaagaagcccggggcctccgtgaaggtcagctgcaaggtgtccggccacaccctcagcgagctgtccatcaactgggtgcgccacgtcccggggaagggcctggagtggatgggcgggctcgaccccgaggacggcgaggcgatccacgagcccaagttccaggggcggctgaccatgacggaggacaccagcaccgacaccgcctacgtggagctgtccagcctccgctccgaggacacggccatgtactactgcgccaccgccgaccccttcaaggtggcgcaggacgagggcctgtacgtcatcttcgactactgggggcagggcaccctggtgaccgtgagctccgccagcacgaagggg

SEQ ID NO: 12139 - RNA, 396 nt, synthetic construct
  misc_feature 1..396: note = derived and/or modified sequence opt1 from anti-HIV_Chain
  source 1..396: mol_type = other RNA
caggtgcagctgctccagagcggcgccgaggtcaagaagcccggggcctccgtgaaggtgagctgcaaggtctccggctacaccctgaccgagctgagcatcaactgggtgcgccaggcgccggggaagggcctcgagtggatgggcgggttcgaccccgaggacgacgaggccatctacgagcccaagttccagggccggctgacgatgaccgaggacacctccaccgacacggcctacatggagctgagctccctccgcagcgaggacaccgccgtgtactactgcgccaccgcggaccccttcaaggtcgcccaggacgaggggctgtacgtgatcttcgactactggggccaggggaccctggtgacggtctccagcgcctccaccaagggc

SEQ ID NO: 12140 - RNA, 396 nt, synthetic construct
  misc_feature 1..396: note = derived and/or modified sequence opt1 from anti-HIV_Chain
  source 1..396: mol_type = other RNA
cagccccagctggtgcagagcggctccggggccgaggtcaagaagccgggcgccagcgtgcgcatctcctgcgaggcgagcgagtacaacgtgttcgaccacttcatgcagtgggtccggcaggcccccgggcagggcctcgagtggatggggtggatcaacccccgcggcggctacccctcctacagcccgaccttccaggggcggctgaccttcacgcgccagccctcctgggacgacagcaccatcaccttccacatggagctgcggggcctcgggcacgacgacaccgccgtgtactactgcgcccgcccccactcccccgacgacgcctggagcctggacgtgtggggccgggggacgctggtcaccgtgtccagcgcgtccaccaagggc

SEQ ID NO: 12141 - RNA, 396 nt, synthetic construct
  misc_feature 1..396: note = derived and/or modified sequence opt1 from anti-HIV_Chain
  source 1..396: mol_type = other RNA
cagccccagctggtgcagagcggctccggggccgaggtcaagaagccgggcgccagcgtgcgcatctcctgcgaggcgagcgagtacaacgtgttcgaccacttcatgcagtgggtccggcaggcccccgggcagggcctcgagtggatggggtggatcaacccccgcggcggctacccctcctacagcccgcggttccaggggcgcctgaccttcacccggcagccctcctgggacgacagctccgtgacgttccacatggagctgcgcggcctccggcacgacgacaccgccgtgtactactgcgcccgcccccacagccccgacgacgcctggtccctggacgtctgggggcggggcaccctggtgaccgtgagctccgcgagcacgaagggg

SEQ ID NO: 12142 - RNA, 396 nt, synthetic construct
  misc_feature 1..396: note = derived and/or modified sequence opt1 from anti-HIV_Chain
  source 1..396: mol_type = other RNA
gaggtgcagctggtcgagagcggcgggggcgtggtggagcccggggagtccctccgcctgagctgcgccgcctccggcttcaccttccggagctacgacatgttctgggtccgccaggcgaccgggaagtccctggagtgggtgagcgccatcggcatcgccggcgacacgtactactccgggagcgtgaagggccggttcaccatctcccgcgagaacgcccggaccagcctctacctgcagctgtccgggctccgcgtcgaggacagcgccgtgtacttctgcgtgcggggctccccgccccgcatcgcggccaccgagtacaactactactacgggctggacgtctggggccagggcacgaccgtgagcgtgttctccgccagcaccaagggg

SEQ ID NO: 12143 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcgccgaggtgaagaagcccgggtccagcgtgaaggtctcctgcaaggccagcggcgggaccttcaccacgtacgacatctcctgggtgcgccaggcgccgggccaggggctcgagtggatgggcggcatcctgcccgacttcggggcccccagctacgcccagaagttccaggaccgggtgaccatcaccaccgacgagtccagctccacggcctacatggagctgaacagcctccgctccgaggacaccgccatctactactgcgcgcggggccgcggggacgacttctggagcggcgagtcccccagctggtacttcgactactgggggcagggcaccctggtcaccgtgtccagcgcctccacgaagggc

SEQ ID NO: 12144 - RNA, 396 nt, synthetic construct
  misc_feature 1..396: note = derived and/or modified sequence opt1 from anti-HIV_Chain
  source 1..396: mol_type = other RNA
cagccccagctggtgcagagcggctccggggccgaggtcaagaagccgggcgccagcgtgcgcatctcctgcgaggcgagcgagtacaacgtgttcgaccacttcatgcagtgggtccggcaggcccccatggaggggctcgagtggatgggctggatcaacccccgcgggggctacccctcctacagcccgaccttccagggccggctgaccttcacgcgccagccctcctgggacgacagcaccatcaccttccacatggagctgcgggggctccgccacgacgacaccgccgtgtactactgcgcccggccccactcccccgacgacgcctggagcctggacgtgtggggccgcgggacgctggtcaccgtgtccagcgcgtccaccaagggc

SEQ ID NO: 12145 - RNA, 396 nt, synthetic construct
  misc_feature 1..396: note = derived and/or modified sequence opt1 from anti-HIV_Chain
  source 1..396: mol_type = other RNA
gaggtgcgcctgctcgagagcggcgggggcctggtccagcccgggggctccctgcggctcagctgctccgccagcgggttcaccttctccaacagcgccctgtcctgggtgcgccaggcgccgggcaagggcctggagtgggtgagctccgtcgtgagctccgggggcgacaccttctacgccgacagcgtgaaggggcggttcacgatctcccgcgacaacagccggaacaccctctacctgcagatgaagtccctgcgcgccgaggacaccgccctctactactgcgccaaggtccagatccagcagctgaacttcggcgtgatcaccgacgcggggatggacgtgtggggcaagggcacgaccgtcatcgtgagctccgccagcaccaagggg

SEQ ID NO: 12146 - RNA, 396 nt, synthetic construct
  misc_feature 1..396: note = derived and/or modified sequence opt1 from anti-HIV_Chain
  source 1..396: mol_type = other RNA
caggtgcagctggtcgagagcggcgggggcgtggtgcagcccgggcgctccctccggctgagctgcgtcggctccgggttcaccttcagctccagcggcatgcactgggtgcgccaggcccccggcaaggggctggagtgggtggccgtcatctccagcgacggctccgacgagtactacggggacagcgtggagggccggttcaccatctcccgcgacaacagcaagaacaccctcttcctgcagctggactccctcgaggcggaggacagcgccgtgtactactgcgccaagacgccgccccactacgacgccctgaccgggtacccctccagcgtcctggagttctggggcctcggcaccctggtgacggtgtccagcgcctccaccaagggg

SEQ ID NO: 12147 - RNA, 396 nt, synthetic construct
  misc_feature 1..396: note = derived and/or modified sequence opt1 from anti-HIV_Chain
  source 1..396: mol_type = other RNA
gaggtgcagctggtccagagcggcgccgaggtgaagaagcccgggtccagcgtgaaggtctcctgcaaggccagcggcgggaccttcaccacgtacgacatctcctgggtgcggcaggcgccgggccaggggctcgagtggatcggcggcatcctgcccgacttcggggcccccagctacgcccagaagttccaggaccgggtgaccatcaccaccgacgagtccagccgcacggcctacatggagctgaactccctccggagcgaggacaccgccatctactactgcgcgcgcggccgcggggacgacttctggtccggcgagagcccctcctggtacttcgactactgggggcagggcacccaggtcaccgtgagctccgccagcacgaagggc

SEQ ID NO: 12148 - RNA, 396 nt, synthetic construct
  misc_feature 1..396: note = derived and/or modified sequence opt1 from anti-HIV_Chain
  source 1..396: mol_type = other RNA
caggtgcagctgctccagagcggcaccgaggtcaagaagcccgggtccagcgtgaaggtgtcctgccgcgccagcggctggaccctggggaactccccgaacagcgccatcggctgggtccggcaggcgcccgggcagggcctggagtggatcggccgcatcatccccatcctcgacgtgacgaactacgcccagaagttccaggggcgggtgaccatctccgccgacaagagcaccaacatcgcctacatggagatctccagcctgggctccgaggacaccgccttctactactgcgcgcgcgtcatcacggggatgaccagcccctggtacttctacatggacgtgtggggcgaggggaccaccgtgatcgtctccagcgcctccacgaagggc

SEQ ID NO: 12149 - RNA, 396 nt, synthetic construct
  misc_feature 1..396: note = derived and/or modified sequence opt1 from anti-HIV_Chain
  source 1..396: mol_type = other RNA
caggtgcacctggtccagagcggcgccgaggtgaagaagcccgggtccagcgtgcgcgtctcctgcaaggccagcggctggaccttcggggactccgtgaacagcgcgatcacctgggtgcggcaggccccgggccaggggctcgagtggatgggccgcttcatccccatcctgggcctgtccaactacgcccagaagttccaggaccgggtcacgatcaacgtggaccgcagcaccaacaccgcctacatggagctctccgggctgcggagcgaggacaccgccgtgtactactgcgcgcgcctgatcacgggcatgaacgccccctggttctactacatggacgtctgggggaagggcaccaccatcaccgtgtccagcgcctccacgaagggg

SEQ ID NO: 12150 - RNA, 396 nt, synthetic construct
  misc_feature 1..396: note = derived and/or modified sequence opt1 from anti-HIV_Chain
  source 1..396: mol_type = other RNA
caggtgcacctggtccagagcggcgccgaggccaagcgccccgggtccagcgtgcgggtgtcctgccgcgcgagcggcggggacttctccagctacaccctctcctgggtccggcaggcccccggccaggggctggagcgcatgggcggcgtggtgcccatgctggacaccgtccactacgcccagaagttccaggggcggctcacgctgagcgtggacgagggcacctccaccgcctacatggagctgagctccctccgcagcgaggacaccgccatgtactactgcacgcgggggcgccagaccttccgggcgatctggtccggcccgcccgtggtcttcgacatctgggggcagggcaccctggtgagcgtgtccagcgcctccaccaagggc

SEQ ID NO: 12151 - RNA, 396 nt, synthetic construct
  misc_feature 1..396: note = derived and/or modified sequence opt1 from anti-HIV_Chain
  source 1..396: mol_type = other RNA
caggtgcacctggtccagagcggcgccgaggccaagcgccccgggtccagcgtgcgggtgtcctgccgcgcgagcggcggggacttctccagctacaccctctcctgggtccggcaggcccccggccaggggatcgagtggatgggcggcgtggtgcccatgctggacaccgtccactacgcccagaagttccaggggcgcctgacgctcagcgtggacgagggcacctccaccgcctacatggagctgagctccctgcggagcgaggacaccgccatgtactactgcacgcgcgggcggcagaccttccgcgcgatctggtccggcccgcccgccgtgttcgacatctgggggcagggcaccctcgtcatcgtgagctccgccagcaccaagggc

SEQ ID NO: 12152 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcgccgagctcaagaagcccgggtccagcgtgaaggtgtcctgcaaggccagcggcgggaccttcaacaaccacaccttcaactgggtccgccaggcgccgggccaggggctggagtggatgggccggacgatccccatcctgggctcccgcgactacgccaagaccttccaggaccgggtgaccatcatcgccgacaagagcacctccacggtgtacctcgagctgcgccggctcaagagcgaggacaccggggtctactactgcgccacctccatgtactacttcgacagcggcgggtactaccgcaacaccgacctggacaagtggggccaggggtccctggtgacggtgagctccgccagcaccaagggc

SEQ ID NO: 12153 - RNA, 396 nt, synthetic construct
  misc_feature 1..396: note = derived and/or modified sequence opt1 from anti-HIV_Chain
  source 1..396: mol_type = other RNA
caggtgtacctggtccagagcggccccgagctcaagaagccgggggcctccgtgaagatcagctgcaaggcctccggctacaacttccccaagtacgcgatccactgggtgcgccaggcccccgggcagggcctgcagtggatggggtggatcaacggcgacaacggcgacgcccggtacagccagaagctgcaggggcgcgtcaccccctccaccgacacgagcgcctccgtggtgtacatggagctcaagcggctgcgcagcgaggacaccgccgtctactactgcgcgcgggccctgtacccgtgggagatcggcggggtgccctccaccatgggcgacgactactgggggcagggcaccctcatcacggtgagctccgccagcaccaagggc

SEQ ID NO: 12154 - RNA, 396 nt, synthetic construct
  misc_feature 1..396: note = derived and/or modified sequence opt1 from anti-HIV_Chain
  source 1..396: mol_type = other RNA
caggtgcagctggtccagagcggccccgagctcatgaagccggggtccagcgtgaaggtgtcctgccgcgccagcggcgacaacttcctgacctccaccttcaactggctgcggcaggcccccgggcagcgcctcgagtggatgggccggttcatccccagcctggggctgatcacgtccgcgcccaagttcagcgaccgcctcaccatcaccgccgaccaggccaccctgacggcctacatggagctgaccggcctcacctccgaggacaccgccctgtactactgcgcgcggggcctgtgccgcgggggcaactgccggctcgggccgagcggctggctggacccctgggggcgcggcacgcaggtcaccgtgtccagcgcctccaccaagggc

SEQ ID NO: 12155 - RNA, 396 nt, synthetic construct
  misc_feature 1..396: note = derived and/or modified sequence opt1 from anti-HIV_Chain
  source 1..396: mol_type = other RNA
ggcgtgcacttccaggggcacctggtccagagcggcgggggcgtgaagaagcccgggtccagcgtgaccatctcctgcctcgccagcgagtacaccttcacggagttcaccatccactggatccgccaggccccgggccagggccccctgtggctggggctcatcaagcggtccggccgcctgatgaccagctaccggttccaggaccgcctgtccctccggcgcgaccggagcaccgggacggtcttcatggagctgcgcggcctgcggatcgacgacaccgcggtgtactactgcgcccgcgacgggctcggcgaggtggcccccgcctacctgtacggcatcgacgtctgggggcagggctccaccgtgatcgtgaccagcgcctccacgagc

SEQ ID NO: 12156 - RNA, 396 nt, synthetic construct
  misc_feature 1..396: note = derived and/or modified sequence opt1 from anti-HIV_Chain
  source 1..396: mol_type = other RNA
caggtgcagctgctccagagcggcgccgaggtcaagaagcccggggcctccgtgaaggtgagctgcaaggtctccggctacaccctgaccgagctgagcatccactgggtgcgccaggcgccggggaagggcctcgagtggatgggcgggttcgaccccgaggacgacgaggccatctacgagcccaagttccagggccggctgacgatgaccgaggacacctccaccgacacggcctacatggagctgagctccctccgcagcgaggacaccgccgtgtactactgcgccaccgcggaccccttcaaggtcgcccaggacgaggggctgtacgtgatcttcgactactggggccaggggaccctggtgacggtctccagcgcctccaccaagggc

SEQ ID NO: 12157 - RNA, 396 nt, synthetic construct
  misc_feature 1..396: note = derived and/or modified sequence opt1 from anti-HIV_Chain
  source 1..396: mol_type = other RNA
caggtgcagctggtccagagcggcgccgaggtgaagaagcccggggcctccgtgaaggtcagctgcaaggtgtccggctacaccctcaccgagctgagcatccactgggtgcgccaggcgccggggaagggcctggagtggatgggcgggttcgaccccgaggacggcgaggcctccttcgagcccaagttccaggggcggctcacgatgaccgaggacaccagcaccgacacggcctacatggagctgtccagcctgcgctccgaggacaccgccgtctactactgcgccaccgcggaccccttcaaggtggcccaggacgagggcctctacgtgatcttcgactactgggggcagggcaccctggtcacggtgagctccgccagcaccaagggg

SEQ ID NO: 12158 - RNA, 396 nt, synthetic construct
  misc_feature 1..396: note = derived and/or modified sequence opt1 from anti-HIV_Chain
  source 1..396: mol_type = other RNA
ggcgtgcacttccaggggcacctggtccagagcggcgggggcgtgaagaagcccgggtccagcgtgaccatctcctgcctcgccagcgagtacaccttcacggagttcaccatccactggatccgccaggccccgggccagggccccctgtggctggggctcatcaagcggtccggccgcctgatgaccagctaccggttccaggaccgcctgtccctccggcgcgaccggagcaccgggacggtcttcatggagctgcgcggcctgcggatcgacgacaccgcggtgtactactgcgcccgcgacgggctcggcgaggtggcccccgcctacctgtacggcatcgacgtctgggggcagggcaccaccgtgatcgtgacgtccgccagcacctcc

SEQ ID NO: 12159 - RNA, 396 nt, synthetic construct
  misc_feature 1..396: note = derived and/or modified sequence opt1 from anti-HIV_Chain
  source 1..396: mol_type = other RNA
caggtgcagctgggcgagagcgggggcgggctcgtcgagcccggcgggtccctgcgcctgagctgcgccgcctccggcttcctcttcagcgactaccagatgtcctggatccggctggcgccgggcaaggggctggagtggatcagcttcatctccggcttcgggagcgtgtactacgccgactccgtggagggccgcttcaccatcagccgggacaacgcccgcaactccctctacctgcagatgaacaacctgcgggccgaggacaccgccgtctactactgcgcgcgcgcctacgggacgggcaactggcggggcctctactactactactacgggatggacgtgtggggccacgggaccaccgtgaccgtcagctccgccagcacgaagggc

SEQ ID NO: 12160 - RNA, 399 nt, synthetic construct
  misc_feature 1..399: note = derived and/or modified sequence opt1 from anti-HIV_Chain
  source 1..399: mol_type = other RNA
caggtgcagctggtccagagcggcaccgccctcaagtcccccgggagctccgccaagctgagctgcaccgtgctgggcgacgagttcgggacgtacttcatctcctggatccgccaggcgccgggccaggggctcgagtgggtgggcggcatcgtcccccacagccagctgcagtccagcgcccagaagttccacgggcggatcatcatctccgccggcgccggggtgaccccgcccgtggtcagcctgcagctcaccaacctgaccttcgaggacacgggcacctacttctgcgcccgcgagcgggggcgccaccgggaccccaagaccggcgacgcgctgcgcggccggtacttcgacttctgggggcgcggcaccgggctccgggtgtccacgagc

SEQ ID NO: 12161 - RNA, 399 nt, synthetic construct
  misc_feature 1..399: note = derived and/or modified sequence opt1 from anti-HIV_Chain
  source 1..399: mol_type = other RNA
gaggtgcagctggtccagagcggcgggggcctcgtgaagcccgggggctccctgcgcctgagctgcgccgcctccgggttcaccttcaagaacgcgtggatgagctgggtgcggcaggccccgggcaagggcctcgagtgggtcgggcacatcaagtccaagaccgacggcgggacgatcgactacgccgcccccgtgaagggccgcttcaccatcagccgggacgactccaagaacaccctgtacctgcagatgaacagcctcaagatcgaggacaccgccgtgtactactgcacgaccgacatcgggtccggccgcggctgggacttccactactacgacagcaacgactgggggcagggcaccctggtcaccgtgtccagcgcgtccacgaagggg

SEQ ID NO: 12162 - RNA, 399 nt, synthetic construct
  misc_feature 1..399: note = derived and/or modified sequence opt1 from anti-HIV_Chain
  source 1..399: mol_type = other RNA
caggtgcagctggtcgagagcggcgggggcgtggtgcagcccgggcgctccctccggctgttctgcgccgccagcggcttcgcgttcaacacctacgggatgcactgggtccgccaggccccgggcaagggcctggagtgggtggccgtgacctggcacgacgggtcccagaagtactacgccgacagcgtcaagggccggttcacgatctcccgcgacaacagcaagaacaccctctacctgcagatgaactccctgcgggccgaggacaccgcgatctactactgcgccagcgaccagggcgggttcgacgactccagcgggtacttcgcccccggcggcatggacgtgtgggggcgcggcaccacggtgatcgtctccagcgcccccaccaagggg

SEQ ID NO: 12163 - RNA, 399 nt, synthetic construct
  misc_feature 1..399: note = derived and/or modified sequence opt1 from anti-HIV_Chain
  source 1..399: mol_type = other RNA
ggctacagcgaggtgcagctggtccagtccgggcccggcctcgtgaagccgagccagaccctgtccctgacctgcacggtgagcgggggctccatcagcaacgggggccactactggaactggatccgccagcaccccggcaaggggctcgagtggatcggccacatctacaacatcgccaccacctactacaacccctccctcaagagccgggtctccatcagcgtggacacctccaagaaccagttcagcctgaagctgtccagcgtgacggccgcggacaccgccgtctactactgcgcccgcgggtccggccggtggaccatcggggcccgcatctacttcgacaactggggccagggcgccctggtggcggtgagctccgccagcaccaagggg

SEQ ID NO: 12164 - RNA, 399 nt, synthetic construct
  misc_feature 1..399: note = derived and/or modified sequence opt1 from anti-HIV_Chain
  source 1..399: mol_type = other RNA
cagctgcagctcaaggagagcggccccgggatggtgaagccgtccgagaccctgagcctgacctgctccgtcagcggcgcctccgtggtgagcgccaacgactactgggggtggatccgccaggcgcccggcaaggggctcgagtgcatcggcatcatcctgtacacgggctccaccttctacaaccccagcctgcagtcccgggtcaccatcagccgcgacccctccaagaaccacgtgagcctcaccctgacgtccgtgaccgccgccgacagcgccgtctactactgcgcccggatcccgtaccactccgagagctactacaacgtggtgatcgggggcttcgacgtctgggggcagggcacccgcgtgaccgtgtccagcgcgtccacgaagggg

SEQ ID NO: 12165 - RNA, 399 nt, synthetic construct
  misc_feature 1..399: note = derived and/or modified sequence opt1 from anti-HIV_Chain
  source 1..399: mol_type = other RNA
tgccaggtgcagctggtcgagagcggcgggggcgtggtgcagcccgggcgctccctccggctgagctgcgtcggctccgggttcaccttcagctccagcggcatgcactgggtgcgccaggcccccggcaaggggctggagtgggtggccgtcatctccagcgacggctccgacgagtactacggggacagcgtggagggccggttcaccatctcccgcgacaacagcaagaacaccctcttcctgcagctggactccctcgaggcggaggacagcgccgtgtactactgcgccaagacgccgccccactacgacgccctgaccgggtacccctccagcgtcctggagttctggggcctcggcaccctggtgacggtgtccagcgcctccaccaagggg

SEQ ID NO: 12166 - RNA, 399 nt, synthetic construct
  misc_feature 1..399: note = derived and/or modified sequence opt1 from anti-HIV_Chain
  source 1..399: mol_type = other RNA
caggtgcagctggtccagagcggcgccgacgtgaagaagcccggggcctccgtgaaggtcagctgcaaggtgtccggctacaccgtgagcgagctctccatccactgggtccgccaggcgccggggaagggcctggagtggatgggcgggttcgaccccgaggacggcaagaccgtgagcgcccagaacttccaggggcgggtgacgatgaccgaggacaagtccaccggcaccgccaacatggagctgcgcagcctccggtccgaggacacggccgtctactactgcgccaccaccgtgcagctgatcgtggacttctgcaacgggggcccctgctacaacttcgacgactgggggcagggcaccctggtcacggtgagctccgcgagcaccaagggc

SEQ ID NO: 12167 - RNA, 399 nt, synthetic construct
  misc_feature 1..399: note = derived and/or modified sequence opt1 from anti-HIV_Chain
  source 1..399: mol_type = other RNA
ggcctggacctcgagcacgacgggcaccacaaggaggagccccgcgccagcgtgaccgtctcctgcgaggccagcggctacaacttcgtgaactacatcatccactgggtgcggctgaccccggggcgcggcttcgagtggatggggatgatcgacccccggcgcggccggccctggtccgcgcagaagttccagggccgcctgacgctcacccgggacatcgacagcgagcgcctgtacatgcagctgtccgggctccggggcgacgacaccgccgtctacttctgcgcccgccaggagcccgacttccacgacgggcacggccacaccctgcgggggatgttcgacagctggggccagggctccccggtgagcgtgtccagcgcctccacgaagggg

SEQ ID NO: 12168 - RNA, 399 nt, synthetic construct
  misc_feature 1..399: note = derived and/or modified sequence opt1 from anti-HIV_Chain
  source 1..399: mol_type = other RNA
caggtgcgcctggtccagagcggcgcccagctcaagaagcccggggcctccgtgaccgtgagctgcgaggcgtccggctacaacttcgtcaactacatcatcaactgggtgcggcagaccccggggcgcagcttcgagtgggtgggcatgatcgacccccggcgcgggcggccctggtccgcccagaagttccagggccgcctgacgctgacccgggacatcgacagcgagaagctctacatgcacctgtccggcctgcgcggggacgacaccgccgtctactactgcgcccggcaggacagcgacttccacgacggccacgggcacaccctccgcggcatgttcgactcctgggggcagggcagccccgtgacggtgtccagcgcctccaccaagggc

SEQ ID NO: 12169 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccgtcgtgaagaccggggcgagcgtgaccatctcctgcgagacggagggctacaccttcgtcaactacatcatccactgggtgcggcagcccccggggcgcggcttcgagtggctcgggatgatcgacccccggaacggccacccctggttcggccagcgcttccgggggcgcctgagcctgcggcgcgaccggtccaccgagaccgtgttcatgacgctcagcggcctgacctccgacgacaacgggatctacttctgcgcccgcaacgagccccagtactacgacggcagcgggcactccctgccgggcatgttcgactactggggccaggggacccgggtcgtggtgagctccgccagcaccaagggc

SEQ ID NO: 12170 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccgtcatgaagaccggggcgagcgtgaccatctcctgcgagacggagggctacaacttcgtgaactacatcatccactgggtccggcggcccccggggcgcggcttcgagtggctcgggatgatcgaccccaagaacggccacccctggttcgcccaggccgtgcgcggccggctgagcctgcgccgggacaccttcaacgaggtggtctacatgaccctctccgggctgaccagcgacgacacgggcctgtacttctgcgcccgcaacgagccccagtaccacgacgggaacggccactccctcccggggatgttcgacttctggggccagggcaccctggtgaccgtgagctccgccagcaccaagggg

SEQ ID NO: 12171 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccgtcgtgaagaccggggcgagcgtgaccatctcctgcgagacggagggctacaccttcgtcaactacatcatccactgggtgcggcagcccccggggcgcggcttcgagtggctcgggatgatcgacccccggaacggccacccctggttcggccagcgcctgcaggggcggctgagcctccgccgggaccgctccaccgagaccgtgttcatgacgctgagcggcctgacctccgacgacaccgggatctacttctgcgcccggaacgagccccagtactacgacggcagcgggcactccctcccgggcatgttcgactactggggccaggggacccgcgtcgtggtgagctccgccagcacgaagggc

SEQ ID NO: 12172 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccgtcgtgaagaccggggcgagcgtgaccatctcctgcgagacggagggctacaccttcgtcaaccacatcatccactgggtgcggcagcccccggggcgcggcttcgagtggctcgggatgatcgacccccggaacggccacccctggttcggccagcgcctgcgggggcgcctgagcctccggcgcgaccggtccaccgagaccgtgttcatgacgctgagcggcctgacctccgacgacatcgggatctacttctgcgcccgcaacgagccccagtacttcgacggcagcgggcactccctcccgggcatgttcgactactggggccaggggacccgggtcgtggtgagctccgccagcaccaagggc

SEQ ID NO: 12173 - RNA, 399 nt, synthetic construct
  misc_feature 1..399: note = derived and/or modified sequence opt1 from anti-HIV_Chain
  source 1..399: mol_type = other RNA
caggtgcagttcttccagagcggctccagcatgaagaagtccggggccagcgtcaccatctcctgcgaggccaccggctacaacatcaagaaccacatcctgcactgggtgcgccagaagcccgggcggggcttcgagtgggtggggatgatcgacccgatcaacggccgcccctggttcggccaggcgttccgggggcgcctcacgctgacccgggacctgagcaccgagaccttctacatgtccctcagcggcctgacgtccgacgacaccgccacctacttctgcgcccgccgggaggccgactaccacgacgggaacggccacaccctgcccgggatgttcgacttctggggccccggcacgctcgtcaccgtgagctccgccagcaccaagggg

SEQ ID NO: 12174 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccgtcgtgaagaccggggcgagcgtgaccatctcctgcgagacggagggctacaccttcgtcaactacatcatccactgggtgcggcagagccccgggcgcggcttcgagtggctcgggatgatcgacccgcggaacggccacccctggttcggccagcgcctgcgggggcgcctgtccctccggcgcgaccggagcaccgagaccgtgttcatgacgctgtccggcctgaccagcgacgacaccgccatctacttctgcgcccgcaacgagccccagtactacgacgggtccggccacagcctccccgggatgttcgactactggggccagggcacccgggtcgtggtgtccagcgcctccacgaagggg

SEQ ID NO: 12175 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccatgaagaagcccggggcgagcgtcaccatctcctgcgagaccgagggctacacgttcatcaactacatcatccactgggtgcggcagccgcccgggcgcggcttcgagtggctcgggatgatcgacccccggaacggccgcccctggttcggccagagcgtgcaggggcggctgtccctgcgccgggacacctacaccgaggtcgtgtacatgaccctcagcggcctgacgtccgacgacgccgggctgtacttctgcgcccgcaacgagccgcagtaccacgacggcaacgggcacagcctccccggcatgttcgactactggggccaggggaccctggtggccgtctccagcgcctccaccaagggc

SEQ ID NO: 12176 - RNA, 399 nt, synthetic construct
  misc_feature 1..399: note = derived and/or modified sequence opt1 from anti-HIV_Chain
  source 1..399: mol_type = other RNA
caggtgcgcctggtccagagcggcgcccagctcaagaagcccggggcctccgtgaccgtgagctgcgaggcgtccggctacaacttcgtcaactacatcatcaactgggtgcggcagaccccggggcgcggcttcgagtgggtggggatgatcgacccccggcgcggccggccctggagcgcccagaagttccagggccgcctgacgctgacccgggacatcgactccgagaagctctacatgcacctgagcgggctgcgcggcgacgacaccgccgtctactactgcgcccggcaggactccgacttccacgacgggcacggccacaccctccgcgggatgttcgacagctggggccagggctcccccgtgacggtgagctccgccagcaccaagggg

SEQ ID NO: 12177 - RNA, 399 nt, synthetic construct
  misc_feature 1..399: note = derived and/or modified sequence opt1 from anti-HIV_Chain
  source 1..399: mol_type = other RNA
caggtgcacaccttccagagcggctccagcatgaagaagtccggggccagcgtcaccatctcctgcgaggccacgggctacaacatcaagaactacatcctgcactgggtgcgccagaagcccgggcggggcttcgagtgggtggggatgatcgacccgatcaacggccgcccctggttcggccagcccttccgggggcgcctcaccctgacccgggacctgagcaccgagacgttctacatgtccctcagcggcctgacctccgacgacaccgcgacctacttctgcgcccgccgggaggccgactaccacgacgggaacggccacacgctgcccgggatgttcgacttctggggcccgggcaccctcatcaccgtcagctccgccagcaccaagggg

SEQ ID NO: 12178 - RNA, 399 nt, synthetic construct
  misc_feature 1..399: note = derived and/or modified sequence opt1 from anti-HIV_Chain
  source 1..399: mol_type = other RNA
caggtgcgcctgttccagagcggcgccgccatgaagaagcccggggcgtccgtcaccatcagctgcgaggcctccggctacaacttcatgaactacttcgtgcactgggtgcggcagcgcccggggcggggcttcgagtggctcgggatgatcaacccccgcggcggccggccctggagcgcccagtccgtccaggggcgcctgaccctgacgcgggacatcagcaccgagatgttctacatgcgcctcgacggcctgcggtccgacgacaccgccacctacttctgcgcccgcaacgaggcggactaccacgacgggaacggccacagcctgcgggggatgttcgactactggggccagggctccctcatcacggtgagctccgccagcaccaagggg

SEQ ID NO: 12179 - RNA, 399 nt, synthetic construct
  misc_feature 1..399: note = derived and/or modified sequence opt1 from anti-HIV_Chain
  source 1..399: mol_type = other RNA
caggtgcagctgttccagagcggcgccgccatgcgcaagcccggggcgtccgtcaccatcagctgcgaggcctccggctacaacttcatgaactacttcgtgcactgggtgcggcagcgcccggggcggggcttcgagtggctcgggatgatcaacccccgcggcggccggccctggagcgcccagtccgtccaggggcgcctgaccctgacgcgggacaccagcaccgagatgttctacatgcgcctcgacggcctgcggtccgacgacaccgccacgtacttctgcgcccgcaacgaggcggactaccacgacgggaacggccacagcctgcgggggatgttcgactactggggccagggctccctcatcaccgtgagctccgccagcaccaagggg

SEQ ID NO: 12180 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccatcaagaagcccggggcgagcgtcaccatctcctgcgagaccgagggctacacgttcatcaactacatcatccactgggtgcggcagccgcccgggcgcggcttcgagtggctcgggatgatcgacccccggaacggccgcccctggttcggccagagcgtgcaggggcggctgtccctgcgccgggacacctacaccgaggtcgtgtacatgaccctcagcggcctgacgtccgacgacaccgggctgtacttctgcgcccgcaacgagccgcagtaccacgacggcaacgggcacagcctccccggcatgttcgactcctggggccaggggaccctggtggccgtcagctccgccagcaccaagggc

SEQ ID NO: 12181 - RNA, 399 nt, synthetic construct
  misc_feature 1..399: note = derived and/or modified sequence opt1 from anti-HIV_Chain
  source 1..399: mol_type = other RNA
caggtgcgcctgttccagagcggcgccgccatgcggaagcccggggcgtccgtcaccatcagctgcgaggcctccggctacaacttcctcaactacttcgtgcactgggtgcgccagcggccggggcgcggcttcgagtggctggggatgatcaacccccggggcggccgcccctggagcgcccagtccgtccaggggcggctgaccctcacgcgcgacaccagcaccgagatgttctacatgcggctggacggcctgcgctccgacgacaccgccacgtacttctgcgcccggaacgaggcggactaccacgacgggaacggccacagcctccgcgggatgttcgactactggggccagggctccctgatcaccgtgagctccgccagcaccaagggg

SEQ ID NO: 12182 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccgtcaagaagcccggggcgagcgtgaccatcgtgtgcgagaccgagggctacaacttcatcgactacatcatccactgggtccggcagccgcccgggcgcggcttcgagtggctcgggatgatcgacccccggaacggccgcccctggtccggccagaaggtgcacgggcggctgagcctgtggcgcgacacgtccaccgagaaggtgtacatgaccctcaccggcctgacgagcgacgacaccgggctgtacttctgcggccggaacgagccgcagtaccacgacgacaacgggcactccctccccggcatgatcgactactggggccaggggaccatggtcaccgtgagctccgccagcacgaagggc

SEQ ID NO: 12183 - RNA, 399 nt, synthetic construct
  misc_feature 1..399: note = derived and/or modified sequence opt1 from anti-HIV_Chain
  source 1..399: mol_type = other RNA
caggtgcgcctgagccagtccggcgccgccatcaagaagcccggggcgagcgtcaccatctcctgcgagaccgagggctacacgttcatcaactacatcatccactgggtgcggcagccgcccgggcgcggcttcgagtggctcgggatgatcgacccccggaacggccgcccctggttcggccagagcgtgcaggggcggctgtccctgcgccgggacacctacaccgaggtcgtgtacatgaccctcagcggcctgacgtccgacgacgccgggcactacttctgcgcccgcaacgagccgcagtaccacgacggcaacgggcacagcctgcccggcatgttcgactactggggccaggggaccctcgtggccgtctccagcgcctccaccaagggc

SEQ ID NO: 12184 - RNA, 399 nt, synthetic construct
  misc_feature 1..399: note = derived and/or modified sequence opt1 from anti-HIV_Chain
  source 1..399: mol_type = other RNA
caggtgcgcctgttccagagcggcgccgccatgcggaagcccggggcgtccgtcaccatcagctgcgaggcctccggctacaacttcatgaactacttcgtgcactgggtgcgccagcggccggggcgcggcttcgagtggctcgggatgatcaacccccggggcggccgcccctggagcgcccagtccgtccaggggcggctgaccctgacgcgcgacaccagcaccgagatgttctacatgcggctcgacggcctgcgctccgacgacaccgccacgtacttctgcgcccggaacgaggcggactaccacgacgggaacggccacagcctgcgcgggatgttcgactactggggccagggctccctcatcaccgtgagctccgccagcaccaagggg

SEQ ID NO: 12185 - RNA, 399 nt, synthetic construct
  misc_feature 1..399: note = derived and/or modified sequence opt1 from anti-HIV_LightChain
  source 1..399: mol_type = other RNA
atgaagctgcccgtgcgcctcctggtcctgatgttctggatcccggccagctccagcgacatcgtgatgacccagagccccctctccctgcccgtgacccccggcgagccggcctccatcagctgccggtccagccagcgcctgctctccagctacgggcacacgtacctgcactggtacctgcagaagcccggccagagcccccagctcctgatctacgaggtctccaaccggttctccggggtgcccgaccgcttcagcggctccgggagcggcaccgacttcaccctgaagatctcccgggtggaggcggaggacgtcggcgtgtactactgcagccagtccacccacgtgccgctcacgttcgggcagggcaccaaggtcgagatcaagcgcaag

SEQ ID NO: 12186 - RNA, 402 nt, synthetic construct
  misc_feature 1..402: note = derived and/or modified sequence opt1 from anti-HIV_Chain
  source 1..402: mol_type = other RNA
cagccctacatcgtgcagagcggcccggccgtcaagggggccggctccagcgtgaccgtgacctgcaaggtcgacggggacgacgacggcatcttctccttcgggacgtacttcatggtgtgggtgcgccaggcgcccggccagggcctgcagtacatgggcgggctcgtccccagctacgcccccacctacgcccacaagttcgaggggcggatcaccatctccgccgccggcaccccgcccgtggtgagcctgacgctgctcaacctgaccaacgacgacgcggccacctacttctgcgcccgcgagcgggggcgccactacgactccaagacccgggagaaccgccggggccgctacttcgacatgtggggccgggggacgcgcatcaccgtcagcccc

SEQ ID NO: 12187 - RNA, 402 nt, synthetic construct
  misc_feature 1..402: note = derived and/or modified sequence opt1 from anti-HIV_Chain
  source 1..402: mol_type = other RNA
cagccctacatcgtgcagagcggcccggccgtcaagggggccggctccagcgtgaccgtgacctgccgcgtcgacggggacgacgacggcatcttcaacttcgggacgtacttcatggtgtgggtgcggcaggcgcccggccagggcctgcagtacatgggcgggctcgtcccctcctacgcccccacctacgcccacaagttcgaggggcgcatcaccatcagcgccgccggcaccccgcccgtggtgtccctgacgctgatcaacctcaccaacgcggacgccgccacctacttctgcgcccgggagcgcgggcggcactacgacagcaagacccgcgagaaccggcgcggccggtacttcgacatgtggggccgcgggacgcggatcaccgtctccccc

SEQ ID NO: 12188 - RNA, 402 nt, synthetic construct
  misc_feature 1..402: note = derived and/or modified sequence opt1 from anti-HIV_Chain
  source 1..402: mol_type = other RNA
cgcgtgcacagccaggtccagctggtggagtccggccccgggctcgtgaagccgagccagaccctgtccctgacctgcacggtcagcggcgggtccatcagcaacggcgggcactactggaactggatccggcagcaccccggcaagggcctcgagtggatcgggcacatctacaacatcgccaccacctactacaacccctccctcaagagccgcgtgtccatcagcgtggacacctccaagaaccagttcagcctgaagctgtccagcgtcacggccgcggacaccgccgtgtactactgcgcccggggctccgggcgctggaccatcggcgcccggatctacttcgacaactgggggcagggcgccctggtggcggtcagctccgccagcaccaagggc

SEQ ID NO: 12189 - RNA, 402 nt, synthetic construct
  misc_feature 1..402: note = derived and/or modified sequence opt1 from anti-HIV_Chain
  source 1..402: mol_type = other RNA
agcgtggacgagcgcctgctcgagttcggcgggcggctggtccagcccggcgggtccctgcgcctcagctgctccgccagcggcttcaccttctccaacagcgccatgtcctgggtgcggcaggcgccggggaagggcctggagtgggtgagctccatcctgagctccggcgtcgggaccttctacgccgacagcgtgaagggccgcttcacggtgtcccgggacaacagccgcaacaccctctacctgcagatgaagtccctgcgggccgaggacaccgccctctactactgcgccaaggtccagatccagcagctgaacttcggggtgatcaccgacgcgggcctggacgtgtgggggaagggcacgaccctcatcgtcagctccgccagcaccaagggc

SEQ ID NO: 12190 - RNA, 402 nt, synthetic construct
  misc_feature 1..402: note = derived and/or modified sequence opt1 from anti-HIV_Chain
  source 1..402: mol_type = other RNA
gtgcagagccaggtctacctggtgcagtccggcggggaggtgaagaagcccggcagctccgtcaaggtgagctgcaaggcctccggggacagcttctccagctccgtgatcacctgggtccgccaggccccgggccaggggcccgagtggatgggccggatcatccccgtgctcggcgtggcggcctacgcccagaacttctacgggcgcgtcaccatcagcgccgacacgtccagcaacaccgcctacatggagctgtccagcctgcggttcgaggacaccgcggtgttctactgcgcccgcgagaccggccgcgggggcaacctcgccctgcggcagtacttcttcgactcctgggggcagggcacgctggtgaccgtcagctcccccagcaccaagggc

SEQ ID NO: 12191 - RNA, 402 nt, synthetic construct
  misc_feature 1..402: note = derived and/or modified sequence opt1 from anti-HIV_Chain
  source 1..402: mol_type = other RNA
cagctgcagctccaggagagcggccccgggctggtgaagccgtccgagaccctgagcctgacctgctccgtcagcgacggctccatcaacagcaactcctactactgggcctggatccgccagagccccgggaagggcctggagtggatcgggtccgtgtactacttcggcggcacgtactacagcccctccctcaagagccgggtgaccatgtccgtcgaccgcagcaagaaccagttctccctcaacgtgagctccgtgaccgccgcggacaccgccatctactactgcgcccggcacgtccgcccctacgaccggagcgggtacccggagcgccccaactggttcgacccctggggccgggggacgctggtgaccgtgtccagcgccagcaccaagggc

SEQ ID NO: 12192 - RNA, 402 nt, synthetic construct
  misc_feature 1..402: note = derived and/or modified sequence opt1 from anti-HIV_Chain
  source 1..402: mol_type = other RNA
caggtgcagctgcaccagtggggcgccgggctcctgaagcccagcgacaccctgtccctgacctgcggcatcctcggggtcagcccgcccggctccctgacggggtactactggacctggatccgccagccgcccggcaagggcctcgagtggatcggggaggtgtaccacagcggctccaccaactacaaccccagcctggcctcccgggtgaccatcagcatggggacgaccaagacccagttctccctgcgcctcaccagcgtcacggcggccgactccgccgtgtactactgcgccagcggcaaggtgtgggggatcaccgcccggccccgcgacgcgggcctggacgtctggggccaggggaccaccgtgacggtgacctccgccagcaccaagggc

SEQ ID NO: 12193 - RNA, 402 nt, synthetic construct
  misc_feature 1..402: note = derived and/or modified sequence opt1 from anti-HIV_Chain
  source 1..402: mol_type = other RNA
caggtgcagctggtccagagcggcgccgaggtgaagaagcccgggtccagcgtgaaggtctcctgccgcgccagcggcgggtccttcggcaactacgcgatcaactgggtgcggcaggccccgatgcaggggctcgagtggatgggcggcatcatccccatcttcgggaccaccaactacgcccagaacttccgcggccgggtgacgatcaacgccgacaccttcaccaacaccgtcaacatggacctgagctccctgcgcagcgaggacacggccgtgtactactgcgggcggtccatcaacgcggccgtgcccggcctcgagggggtctactactactacggcatggccgtgtggggccaggggaccaccgtgaccgtcagctccgccagcacgaagggc

SEQ ID NO: 12194 - RNA, 402 nt, synthetic construct
  misc_feature 1..402: note = derived and/or modified sequence opt1 from anti-HIV_Chain
  source 1..402: mol_type = other RNA
ttcgtgcagctggtcgagagcggcgggggcctcgtgcagcccgggggctccctgcgcctgagctgcgccgcctccgggttcaacttcaacacctactggatgaactgggtgcggcaggcgccgggcaagggcctcgagtgggtcgccaacatgaaggaggacgggagcgagaagtactacgtggactccgtgaagggccgcttcaccatcagccgggacaacgccaagaactccctgtacctgcagatgaacagcctccgcgccgaggacacggccgtctactactgcgcgcggaaccccgagtcccgctgcatcgtggggcggaaccgcggctggtgccggtacttcgacctgtgggggcgcggcagcctggtgaccgtctcccccgccagcaccaagggc

SEQ ID NO: 12195 - RNA, 405 nt, synthetic construct
  misc_feature 1..405: note = derived and/or modified sequence opt1 from anti-HIV_Chain
  source 1..405: mol_type = other RNA
cagctgcagctcgaccagcccggcgccgccatgaagtccctggggagcagcctgaccatcacgtgccgcgtgtccggcgacgacctcgggagcttccacttcggcacctacttcatgatctgggtccggcaggggccgggccagggcctggagtacatgggcgggatcctgccctccaccaagacccccacctacgcgcacaagttccgcgggcgggtgagcatctccgcccccggcgtgccgcccgtcctcagcctggccctgacgaacctcacctacgacgacaccgccacctacttctgcgcccgcgagcgggggcgccacttcgagcccaagaaccgggaccacctggagggcaagttcctggacctctggggccgcgggacgttcgtgcgggtgtccccc

SEQ ID NO: 12196 - RNA, 405 nt, synthetic construct
  misc_feature 1..405: note = derived and/or modified sequence opt1 from anti-HIV_Chain
  source 1..405: mol_type = other RNA
caggtgcagctggtccagcccggcaccgccatgaagtccctcgggagcagcctgaccatcacgtgccgcgtgtccggcgacgacctggggagcttccacttcggcacctacttcatgatctgggtgcggcaggccccggggcagggcctcgagtacatgggcgggatcctgccctccaccaagacccccacgtacgcgcacaagttccgcggccgggtcagcatctccgcccccggggtgccgcccgtgctgagcctcgccctgaccaacctgacctacgacgacaccgccacgtacttctgcgcccgcgagcggggccgccacttcgagcccaagaaccgggacaacctcgaggggaagttcttcgacctgtggggccgcggcaccttcgtccgggtgtccccc

SEQ ID NO: 12197 - RNA, 405 nt, synthetic construct
  misc_feature 1..405: note = derived and/or modified sequence opt1 from anti-HIV_Chain
  source 1..405: mol_type = other RNA
caggtgcagctggtccagcccggcaccgccatgaagaccctcgggagctccctgacgatcagctgccgcgtgtccggcgacgacgggaacttccacttcggcacctacttcatggcctgggtgcggcaggtcccggggcagggcctggagtacatgggcgggatcctccccagcaccaagtcccccacctacgcgcacaagttccgcggccgggtgagcatctccacggccggggtgcccccggtcgtgagcctggccctgaccaacctcacctacgacgacaccgccacgtacttctgcgcccgcgagcggggccgccactacgactccaagaagcaggagaactaccgggggaagttcttcgacctgtggggccgcggcacctgggtgcgggtcagccccacc

SEQ ID NO: 12198 - RNA, 405 nt, synthetic construct
  misc_feature 1..405: note = derived and/or modified sequence opt1 from anti-HIV_Chain
  source 1..405: mol_type = other RNA
cacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgaccagtggtccgggctccaccacgacggcgtcatggccttcagctcctgggggcagggcacgctgatcagcgtgtccgcggccagcaccaagggg

SEQ ID NO: 12199 - RNA, 405 nt, synthetic construct
  misc_feature 1..405: note = derived and/or modified sequence opt1 from anti-HIV_Chain
  source 1..405: mol_type = other RNA
caggtgcagctggtccagagcggcgccgaggtgaagaagcccgggtccagcgtgaaggtctcctgcaaggccagcggcgggaccttctccacctacgcgttcagctgggtgcgccaggccccgatcgagggcctcgagtggatgggcgggatcatccccatcttcggcacggagaactacgcccagaagttccaggggcgggtgaccatcaccgccgacaagtccaccagcacggcctacatggagctgtccagcctgcgctccgaggacaccgcggtctactactgcgcccgggaccgcagctccgccatcggctactgcagctccatcagctgctacaaggggtccttcgacatctggggccaggggaccatggtgaccgtgagctccgccagcacgaagggc

SEQ ID NO: 12200 - RNA, 405 nt, synthetic construct
  misc_feature 1..405: note = derived and/or modified sequence opt1 from anti-HIV_Chain
  source 1..405: mol_type = other RNA
caggtgcagctggtccagagcggcgccgaggtgaagaagcccgggtccagcgtgaaggtctcctgcaaggccagcggcgggaccttctccacctacgcgttcagctgggtgcgccaggccccgggccaggggctcgagtggatgggcggcatcatccccatcttcgggacggagaactacgcccagaagttccagggccgggtgaccatcaccgccgacaagtccaccagcacggcctacatggagctgtccagcctgcgctccgaggacaccgcggtctactactgcgcccgggaccgcagctccgccatcgggtactgcagctccatcagctgctacaagggctccttcgacatctgggggcagggcaccatggtgaccgtgagctccgccagcacgaagggc

SEQ ID NO: 12201 - RNA, 405 nt, synthetic construct
  misc_feature 1..405: note = derived and/or modified sequence opt1 from anti-HIV_Chain
  source 1..405: mol_type = other RNA
gaggtgcagctggtcgagagcggcgggggcctcgtgcagcccgggggctccctgcgcctgagctgcgccgcctccgggttcaccttcagctcctacagcatgaactgggtgcggcaggcgcccggcaagggcctcgagtgggtctcctacatcagcgggtccagctacaccatctactacgccgactccgtgcgcggccggttcacgatcagccgcgacaacgccaagaactccctgtacctgcagatgaacagcctccgggacgaggacaccgccgtgtacttctgcgcccgcgcgaccccgcccaaccccctgaacctgtacaactacgactccagcgggtccagcttcgactactggggccaggggaccctcgtcacggtgtccagcgccagcaccaagggc

SEQ ID NO: 12202 - RNA, 405 nt, synthetic construct
  misc_feature 1..405: note = derived and/or modified sequence opt1 from anti-HIV_Chain
  source 1..405: mol_type = other RNA
gaggtgcagctggtccagagcggcgccgaggtgaagaagcccgggtccagcgtgaaggtctcctgcaaggccagcggcgggaccttctccacctacgcgttcagctgggtgcgccaggccccgggccaggggctcgagtggatgggcggcatcatccccatcttcgggacggagaactacgcccagaagttccagggccgggtgaccatcaccgccgacaagtccaccagcacggcctacatggagctgtccagcctgcgctccgaggacaccgcggtctactactgcgcccgggaccgcagctccgccatcgggtactgcagctccatcagctgctacaagggctccttcgacatctgggggcagggcaccatggtgaccgtgagctccgccagcacgaagggc

SEQ ID NO: 12203 - RNA, 405 nt, synthetic construct
  misc_feature 1..405: note = derived and/or modified sequence opt1 from anti-HIV_Chain
  source 1..405: mol_type = other RNA
gaggtgcagctggtcgagagcggcgccgaggtgaagaagcccgggtccagcgtgaaggtctcctgcaaggccagcggcgggaccttctccacctacgcgttcagctgggtgcgccaggccccgggccaggggctcgagtggatgggcggcatcatccccatcttcgggacggagaactacgcccagaagttccagggccgggtgaccatcaccgccgacaagtccaccagcacggcctacatggagctgtccagcctgcgctccgaggacaccgcggtctactactgcgcccgggaccgcagctccgccatcgggtactgcagctccatcagctgctacaagggctccttcgacatctgggggcagggcaccatggtgaccgtgagctccgccagcacgaagggc

SEQ ID NO: 12204 - RNA, 405 nt, synthetic construct
  misc_feature 1..405: note = derived and/or modified sequence opt1 from anti-HIV_Chain
  source 1..405: mol_type = other RNA
cccctggtgcagctcgagccgagcggcgtcgaggtgaagaagcgcggggcctccgtgaaggtcagctgcaaggtgtccggctacagcctgaccgagctgtccatgcactgggtgcggcaggcccccgggaagggcctcgagtggatggggagcttcgaccccctggacggcgacaccatctacgcgcagaagttccagggccgcgtcacgatgaccgtggacacctccaccgacacggcctacatggacctgagctccctccggttcgaggacaccgccgtgtactactgcgccacccccagcaaggcctactactacgactccccgaactacgagggggacttctacatggacgtctggggcaaggggaccacggtgatcgtgagctccgcgagcaccaagggc

SEQ ID NO: 12205 - RNA, 408 nt, synthetic construct
  misc_feature 1..408: note = derived and/or modified sequence opt1 from anti-HIV_HeavyChain
  source 1..408: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagctgacctccgacgacaccgccgtgtacttctgcacgaccaccagcacctacgacaagtggtccgggctccaccacgacggcgtcatggccttcagctcccgcgggcagggcacgctgatcagcgtgtccgcggccagcaccaagggg

SEQ ID NO: 12206 - RNA, 408 nt, synthetic construct
  misc_feature 1..408: note = derived and/or modified sequence opt1 from anti-HIV_HeavyChain
  source 1..408: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccaggggctggagtacatcggccagatctggcggtggaagtccagcgccagccaccacttccgcggccgggtcctgatctccgccgtggacctcaccgggagctccccgcccatcagctccctggagatcaaggtgaccagcgacgacaccgccgtctacttctgcacgaccacctccacctacgacgagtggagcgacctgcaccacgacggcgtgatggccttctccagctgggggcagggcacgctcatctccgtgagcgcggcctccaccaagggg

SEQ ID NO: 12207 - RNA, 408 nt, synthetic construct
  misc_feature 1..408: note = derived and/or modified sequence opt1 from anti-HIV_HeavyChain
  source 1..408: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagctgacctccgacgacaccgccgtgtacttctgcacgaccaccagcacctacgaccgctggtccgggctccaccacgacggcgtcatggccttcagctcctgggggcagggcacgctgatcagcgtgtccgcggccagcaccaagggg

SEQ ID NO: 12208 - RNA, 408 nt, synthetic construct
  misc_feature 1..408: note = derived and/or modified sequence opt1 from anti-HIV_Chain
  source 1..408: mol_type = other RNA
tgcaacccccgcgtgcacagcgaggtccagctggtggagtccggcgccgaggtgaagaagccgggggccagcgtcaaggtggcctgcaaggtgtccggcaagaagctcagcgacctgtccatccactgggtccggcaggcccccgggaagggcctggagtggatgggcgggttcgacgaggaggacggcaagatcagctacgagcgcaagttccaggggcgggtgtccatgaccgaggacaccgcccgcgacacggccttcatggagatgagctccctccggagcgacgacaccgccgtgtacttctgcgcggccgcgccccgcctggacctgggcgagctctccagcgggttccacttctggggcctggggaccctggtcaccgtgtccagcgcctccacgaagggc

SEQ ID NO: 12209 - RNA, 408 nt, synthetic construct
  misc_feature 1..408: note = derived and/or modified sequence opt1 from anti-HIV_Chain
  source 1..408: mol_type = other RNA
atctgggcgcccctgatcgccgtgaccttcctcgtcctgcactgcgagagcctggggacctgctgctgctgccaggcctccgggggcacgttcaacaccttcgccatcaactgggtgcgccaggccccggggcagggcctcgagtgggtgggcggcatcatccccgtcttcggcaccgccagctacgcccagaagttccaggggcgggtgaccgtgacgaccgacgagtcccgcggcaccgcgtacatggagctgaacagcctgcggtccgaggacaccgccgtctactactgcgcccgcgggcagacggacctcaacgacgacctgtggagcgactactccacccccggcttcgactactgggggcagggcaccctggtgaccgtgagctccgccagcacgaagggc

SEQ ID NO: 12210 - RNA, 408 nt, synthetic construct
  misc_feature 1..408: note = derived and/or modified sequence opt1 from anti-HIV_Chain
  source 1..408: mol_type = other RNA
ctgcagccccgcgtgcacagcgaggtccagctcgtggagtccggcgccgaggtgaagaagccgggggccagcgtcaaggtgtcctgcaaggtgagcggctacaccctgtccgacctgagcatgcactgggtccggcaggcgcccgggaagggcctcgagtggatgggcgggttcgacgaggaggacggcgagatcacctacgcccagaagttccaggggcgcgtgtccatgacggaggacaccagccgggacaccgcctacatggagctgtccagcctgcgctccgaggacaccgccgtgtactactgcgccacggcgccccggctcgagctgggcgagctgagctccgggttccactactggggcctcgggaccctggtcaccgtgagctccgccagcaccaagggc

SEQ ID NO: 12211 - RNA, 408 nt, synthetic construct
  misc_feature 1..408: note = derived and/or modified sequence opt1 from anti-HIV_Chain
  source 1..408: mol_type = other RNA
cagagccaggtgcacctggtccagtccggcgccgaggtgaagaagcccgggagctccgtgaaggtcagctgccaggcctccggcgggaccttcaacaccttcgcgatcaactgggtgcgccaggccccgggccaggggctcgagtgggtgggcggcatcatccccgtcttcgggacggccagctacgcccagaagttccagggccgggtgaccgtgaccaccgacgagtcccgcgggacggcctacatggagctgaacagcctgcggtccgaggacaccgcggtctactactgcgcccgcggccagaccgacctcaacgacgacctgtggagcgactactccacccccgggttcgactactggggccagggcacgctggtgaccgtgagctccgccagcaccaagggg

SEQ ID NO: 12212 - RNA, 408 nt, synthetic construct
  misc_feature 1..408: note = derived and/or modified sequence opt1 from anti-HIV_Chain
  source 1..408: mol_type = other RNA
ggcagcgaggtgcagctggtcgagtccggggccgaggtgaagaagcgcggcgccagcgtgaaggtctcctgcaaggtgagcgggtactccctcaccgagctgagcatgcactgggtgcggcaggcgcccggcaaggggctggagtggatgggctccttcgacccgctcgacggcgacaccatctacgcccagaagttccaggggcgcgtcacgatgaccgtggacaccagcaccgacacggcctacatggacctgtccagcctgcggttcgaggacaccgccgtgtactactgcgccaccccctccaaggcgtactactacgacagccccaactacgagggcgacttctacatggacgtctgggggaagggcaccacggtgatcgtgtccagcgcctccaccaagggg

SEQ ID NO: 12213 - RNA, 408 nt, synthetic construct
  misc_feature 1..408: note = derived and/or modified sequence opt1 from anti-HIV_Chain
  source 1..408: mol_type = other RNA
caggtgcagctggtccagagcggcggggaggtgaagaagcccggcgcctccgtgaaggtcagctgcaaggtgtccgggtacagcctcaccgagctgtccatgcactgggtgcgccaggccccgggcaaggggctggagtggatgggcgtcttcgaccccctcgagggcgacggggtgtacgtgcagaagttccggggccgcgtcatcatgaccgaggacacgagcaccgacaccgcgtacatggagctgacctccctgcggagcgaggacacggccatctactactgcgccaccaaggccaaggactactactacgagtccagcgactactccccctactactactactacatggacgtgtgggggaagggcaccaccgtgacggtcagctccgccagcaccaagggg

SEQ ID NO: 12214 - RNA, 408 nt, synthetic construct
  misc_feature 1..408: note = derived and/or modified sequence opt1 from anti-HIV_Chain
  source 1..408: mol_type = other RNA
gaggtgcagctggtccagagcggcgccgaggtgaagaagcccggggcctccgtgaaggtcagctgcaaggtgtccggctacaccctcaccgagctgagcatgcactgggtgcgccaggcgccggggaagggcctggagtggatgggggtcttcgaccccctcgagggcgacggcgtgtacgccgagaagttccgggggcgcgtgatcatgacggaggacacctccaccgacaccggctacatggagctgacgagcctgcggtccgaggacaccgccatctactactgcgccaccaaggccaaggactactactacgagagctccgactacagcccctactactactactacatggacgtctgggggaagggcaccacggtgaccgtgtccagcgcgtccaccaagggg

SEQ ID NO: 12215 - RNA, 408 nt, synthetic construct
  misc_feature 1..408: note = derived and/or modified sequence opt1 from anti-HIV_Chain
  source 1..408: mol_type = other RNA
caggtgcagctggtccagagcggcgccgaggtgaagaagcccggggcctccgtgaaggtcagctgcaaggcgtccggctacaccttcacccgctaccacatccactgggtgcggcacgccccggggcagggcctcgagtggatggggaagatcaaccccagccgcgcctccacgaagtacgccaagaagttccaggaccgggtgaccatgacccgcgacaccagcacgtccaccgtctacatggagctgagctccctgcggggcgacgacaccgccgtgtactactgcggccgcgagatggggaccttcacgctcctgggcgtggtcatcgaccactacgacttctaccccatggacgtgtgggggcagggcacccccgtgaccgtcagctccgcgagcaccaagggg

SEQ ID NO: 12216 - RNA, 408 nt, synthetic construct
  misc_feature 1..408: note = derived and/or modified sequence opt1 from anti-HIV_Chain
  source 1..408: mol_type = other RNA
agccggcccccgtcctgcctgctcggctgctggtgctgcagcgggttcctgctgcccgccgtgatcctccccaacctgcactccccctgcctgagcctcctggagtcccagccgcccagcctggccgacctcgtctccgcgttcgccgtgatggacatccccatctacatcggcacctaccgcagccaggcctccctgcacagctccagcaccaagttccccacggacttcctggggtcccagaccggcagcgtggccgtcgggcagggccagatctcccacctccgcagcgtggagtggcggctgcgcatgtgggagttcatcaccgccctgaaggtgcacatgttcctctcccggagcgaccgcggcccgcggtggaagaacgtctccagcctgctgaacagccgc

SEQ ID NO: 12217 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcatcatcagcgccgtggacctgaccggctccagcccgcccatcagccccctcgagatcaagaacctgacctccgacgacaccgccgtgtacttctgcacgaccacctccaccagcgaccgctggtccgggctgcaccacgacggcgtcatggccttcagctcctgggggcagggcacgctcatcagcgtgtccgcggccagcaccaagggg

SEQ ID NO: 12218 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcatcatcagcgccgtggacctgaccggctccagcccgcccatctccagcctcgagatcaagaacctgacctccgacgacaccgccgtgtacttctgcacgaccgccagcacctacgacaagtggtccgggctgcaccacgacggcgtcatggcgttcagctcctgggggcagggcaccctcatcagcgtgtccgccgccagcacgaagggg

SEQ ID NO: 12219 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggcccctccccgcccatcagctccctggagatcaagaacctgaccagcgacgacaccgccgtgtacttctgcacgaccacctccacctacgacaagtggagcgggctccaccacgacggcgtcatggccttctccagctgggggcagggcacgctgatctccgtgagcgcggcctccaccaagggg

SEQ ID NO: 12220 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtggccgtgtcctgcaaggcctacggcgtcaacaccttcgggctctacgcggtgaactgggtgcgccaggcccccggccagagcctggagtacatcgggcagatctggcggtggaagtccagcgcctcccacgacttccgcggccgggtcatcatcagcgccgtggacctgacgggctccagcccgcccatctccagcctcgagatcaagaacctgacctccgacgacaccgccgtgtacttctgcaccgcgacgagcacccccgactactggtccgggctgcaccacgacggcgtcatggccttcagctcctgggggcagggcaccctcatcagcgtgtccgccgccagcaccaagggg

SEQ ID NO: 12221 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccggggtcaagaagcccggctccagcgtgaccgtgtcctgcaaggcctacggggtcaacacgttcggcctctacgccgtgaactgggtgcgccaggcgcccgggcagggcctggagtacatcggccagatctggcggtggaagtccagcgccagccaccacttccgcgggcgggtcctgatctccgccgtggacctcaccggcagctccccgcccatcaccagcctggagatcaagaacgtgacctccgacgacacggccgtctacttctgcaccaccaccagcacgtacgacaagtggtccgggctgtaccacgacggcgtgatggccttcagctcctgggggcagggcaccctcatcagcgtgtccgcggccagcaccaagggc

SEQ ID NO: 12222 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcatcatcagcgccgtggacctgaccggctccagcccgcccatctccagcctcgagatcaagaacctgacctccgacgacaccgccgtgtacttctgcacgaccaccagcacctccgactactggagcgggctgcaccacgacggcgtcatggccttctccagctgggggcagggcacgctcatctccgtgagcgcggccagcaccaagggg

SEQ ID NO: 12223 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgaccgctggtccgggctccaccacgacggcgtcatggccttcagctcctgggggcagggcacgctgatcagcgtgtccgcggccagcaccaagggg

SEQ ID NO: 12224 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtccgcaagcccgggtccagcgtgaccgtgtcctgcaaggcctacggcgtcaacacgttcgggctctacgccgtgaactgggtgcggcaggcgcccggccagagcctggagtacatcgggcagatctggcgctggaagtccagcgcctcccaccacttccggggccgcgtcctgatcagcgccgtggacctcaccggctccagcccgcccatctccagcctggagatcaagaacctgacctccgacgacaccgccgtgtacttctgcacgaccaccagcacctacgacaagtggtccgggctccaccacgacggcgtcatggccttcagctcctgggggcagggcacgctgatcagcgtgtccgcggccagcaccaagggg

SEQ ID NO: 12225 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgaccagtggtccgggctccaccacgacggcgtcatggccttcagctcctgggggcagggcacgctgatcagcgtgtccgcggccagcaccaagggg

SEQ ID NO: 12226 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgagctgggtgcgccaggcgcccggccagcggctggagtacatcgggcagatccgccggtggaagtccagcgcctcccaccacttccgcggccgggtcaccgtgagcgccgtggaccccaccggctccagcccgcccatctccagcctggagatccgcgacctcaccacggacgacaccgccgtctacttctgcaccaccacgtccaccagcgactactggtccgggctgcacaacgagcggggcaccgccttcagctcctgggggcagggcaccctgatcagcgtgtccgcggccagcacgaagggg

SEQ ID NO: 12227 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccaggggctggagtacatcggccagatctggcggtggaagtccagcgccagccaccacttccgcggccgggtcctgatctccgccatcgacctcaccgggagctccccgcccatcagctccctggagatcaagaacgtgaccagcgacgacaccgccgtgtacttctgcacgaccatgtccacctacgacaagtggagcggcctgcaccacgacggggtcatggccttctccagctggggccaggggaccctcatctccgtgagcgcggcctccacgaagggc

SEQ ID NO: 12228 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacgaggtcaacacgttcggcctctacgccgtgaactgggtgcgccaggcgcccgggcagagcctggagtacatcggccagatctggcggtggaagtccagcgcctcccaccacttccgcgggcgggtcctgatcagcgccgtggacctcaccggctccagcccgcccatctccagcctggagatcaagaacgtgacctccgacgacaccgccgtctacttctgcacgaccaccagcacccacgacaagtggtccggcctgcaccacgacggggtgatggccttcagctcctggggccaggggacgctcatcagcgtgtccgcggccagcaccaagggc

SEQ ID NO: 12229 - RNA, 411 nt, synthetic construct
  misc_feature 1..411: note = derived and/or modified sequence opt1 from anti-HIV_HeavyChain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccaggggctggagtacatcggccagatctggcggtggaagtccagcgccagccaccacttccgcggccgggtcctgatctccgccgtggacctcaccgggagctccccgcccatcagctccctggagatcaagaacgtgaccagcgacgacaccgccgtctacttctgcacgaccacctccacctacgacaagtggagcggcctgcaccacgacggggtggtggccttctccagctggggccaggggacgctcatctccgtcagcgcggcctccaccaagggc

SEQ ID NO: 12230 - RNA, 411 nt, synthetic construct
  misc_feature 1..411: note = derived and/or modified sequence opt1 from anti-HIV_Chain
  source 1..411: mol_type = other RNA
caggtgaccctggtccagagcggcgccgaggtgaagaagcccggggcctccgtgcgcatcagctgccgggcgtccggcttcaccttcgacgactacagcgactactccttcatcccgacgacctacctcatccactggttccgccaggcccccgggcagggcctggagtggatggcctggatcaacagcgtcaacgggggccggaacatcgcccgccagttccagggccgggtgaccgtggcccgcgaccggtccaacagcatcgcgttcctggagttctccgggctccgccacgacgacaccgccgtctacttctgcgcccgggaccgccgggacgacgaccgcgcctggctgctggacccctggggccaggggacgcgggtgaccgtgagctccgcgagcaccaagggc

SEQ ID NO: 12231 - RNA, 411 nt, synthetic construct
  misc_feature 1..411: note = derived and/or modified sequence opt1 from anti-HIV_Chain
  source 1..411: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgacaagtggtccgggctccaccacgacggcgtcatggccttcagctcctgggggcagggcacgctgatcagcgtgtccgcggccagcaccaagggg

SEQ ID NO: 12232 - RNA, 414 nt, synthetic construct
  misc_feature 1..414: note = derived and/or modified sequence opt1 from anti-HIV_Chain
  source 1..414: mol_type = other RNA
gtggtccagctggtgcagagcggcgccgaggtgcgcaagcccgggtccagcctcaaggtctcctgcaagagctccggcgggaccttcagccggttcgtggtgaactgggtccgccaggccccgggccaggggctggagtggatgggcggcatgatccccatcttcgggatcgcgaagtacgcccagaagttccaggaccgggtgaccatgacggccgacgagtccaagaacaccgtgtacctggacttcagctccctccgcagcgacgacaccgccgtctactactgcgcccgggaccgcggcgacacccggctgctggactacggggactacgaggacgagcgctactactacggcatggacgtgtgggggcagggcacgaccgtgatcgtctccagcgcgtccaccaagggc

SEQ ID NO: 12233 - RNA, 414 nt, synthetic construct
  misc_feature 1..414: note = derived and/or modified sequence opt1 from anti-HIV_Chain
  source 1..414: mol_type = other RNA
caggtgcagctggtccagagcggcgccgaggtgcgcaagcccgggtccagcctcaaggtgtcctgcaagagctccggcgggaccttcagccggttcgtcgtgaactgggtgcgccaggccccgggccaggggctggagtggatgggcggcatgatccccatcttcgggatcgcgaagtacgcccagaagttccaggaccgggtcaccatgacggccgacgagtccaagaacaccgtgtacctggacttcagctccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12234 - RNA, 414 nt, synthetic construct
  misc_feature 1..414: note = derived and/or modified sequence opt1 from anti-HIV_Chain
  source 1..414: mol_type = other RNA
gaggtgcagctggtcgagagcggcgccgaggtgcgcaagcccgggtccagcctcaaggtgtcctgcaagagctccggcgggaccttcagccggttcgtcgtgaactgggtgcgccaggccccgggccaggggctggagtggatgggcggcatgatccccatcttcgggatcgcgaagtacgcccagaagttccaggaccgggtcaccatgacggccgacgagtccaagaacaccgtgtacctggacttcagctccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12235 - RNA, 414 nt, synthetic construct
  misc_feature 1..414: note = derived and/or modified sequence opt1 from anti-HIV_Chain
  source 1..414: mol_type = other RNA
caggtgcagctggtcgagagcggcgccgaggtgcgcaagcccgggtccagcctcaaggtgtcctgcaagagctccggcgggaccttcagccggtacgtcgtgaactgggtgcgccaggccccgggccaggggctggagtggatgggcggcatcatccccatcttcgggatcgcgaagtacgcccagaagttccaggaccgggtcaccatgacggccgacgagcccaagaacaccgtgtacctggacttcaactccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12236 - RNA, 414 nt, synthetic construct
  misc_feature 1..414: note = derived and/or modified sequence opt1 from anti-HIV_Chain
  source 1..414: mol_type = other RNA
caggtgcagctggtccagagcggcgccgaggtgcgcaagcccgggtccagcctcaaggtgtcctgcaagagctccggcgggaccttcagccggtacgtcgtgaactgggtgcgccaggccccgggccaggggctggagtggatgggcggcatgatccccatcttcgggatcgcgaagtacgcccagaagttccaggaccgggtcaccatgacggccgacgagtccaagaacaccgtgtacctggacttcagctccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12237 - RNA, 414 nt, synthetic construct
  misc_feature 1..414: note = derived and/or modified sequence opt1 from anti-HIV_Chain
  source 1..414: mol_type = other RNA
caggtgcagctggtccagagcggcgccgaggtgcgcaagcccgggtccagcctcaaggtgtcctgcaagagctccggcgggaccttcagccggtacgtcgtgaactgggtgcgccaggccccgggccaggggctggagtggatgggcggcatcatccccatcttcgggatcgcgaagtacgcccagaagttccaggaccgggtcaccatgacggccgacgagtccaagaacaccgtgtacctggacttcagctccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12238 - RNA, 414 nt, synthetic construct
  misc_feature 1..414: note = derived and/or modified sequence opt1 from anti-HIV_Chain
  source 1..414: mol_type = other RNA
caggtgcagctggtcgagagcggcgccgaggtgcgcaagcccgggtccagcctcaaggtgtcctgcaagagctccggcgggaccttcagccggtacgtcgtgaactgggtgcgccaggccccgggccaggggctggagtggatgggcggcatcatccccatcttcgggatcgcgaagtacgcccagaagttccaggaccgggtcaccatgacggccgacgagtccaagaacaccgtgtacctggacttcagctccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12239 - RNA, 414 nt, synthetic construct
  misc_feature 1..414: note = derived and/or modified sequence opt1 from anti-HIV_Chain
  source 1..414: mol_type = other RNA
caggtgcagctggtccagagcggcgccgaggtgcgcaagcccgggtccagcctcaaggtgtcctgcaagagctccggcgggaccttcagccggtacgtcgtgaactgggtgcgccaggccccgggccaggggctggagtggatgggcggcatcatccccatcttcgggatcgcgaagtacgcccagaagttccaggaccgggtcaccatgacggccgacgagcccaagaacaccgtgtacctggacttcaactccctccgcagcgacgacaccgccgtgtactactgcgcccgggaccgcggcgacacccggctgctggactacggggactacgaggacgagcgctactactacggcatggacgtctgggggcagggcacgaccgtgatcgtgtccagcgcgtccaccaagggc

SEQ ID NO: 12240 - RNA, 414 nt, synthetic construct
  misc_feature 1..414: note = derived and/or modified sequence opt1 from anti-HIV_Chain
  source 1..414: mol_type = other RNA
gtggtccagctggtgcagagcggcgccgaggtgcgcaagcccgggtccagcctcaaggtctcctgcaagagctccggcgggaccttcagccggtacgtggtgaactgggtccgccaggccccgggccaggggctggagtggatgggcggcatgatccccatcttcgggatcgcgaagtacgcccagaagttccaggaccgggtgaccatgacggccgacgagtccaagaacaccgtgtacctggacttcagctccctccgcagcgacgacaccgccgtctactactgcgcccgggaccgcggcgacacccggctgctggactacggggactacgaggacgagcgctactactacggcatggacgtgtgggggcagggcacgaccgtgatcgtctccagcgcgtccaccaagggc

SEQ ID NO: 12241 - RNA, 414 nt, synthetic construct
  misc_feature 1..414: note = derived and/or modified sequence opt1 from anti-HIV_Chain
  source 1..414: mol_type = other RNA
ttcatctgcttcagcgtggtcgtgcgcctgctcgagttcggcgggcggctggtgcagcccggcgggtccctgcgcctcagctgctccgccagcggcttcaccttctccaacagcgccatgtcctgggtccggcaggcgccggggaagggcctggagtgggtgagctccatcctgagctccggcgtggggaccttctacgccgacagcgtcaagggccgcttcacggtgtcccgggacaacagccgcaacaccctctacctgcagatgaagtccctgcgggccgaggacaccgccctctactactgcgccaaggtgcagatccagcagctgaacttcggggtcatcaccgacgcgggcctggacgtgtgggggaagggcacgaccctcatcgtgagctccgccagcaccaagggc

SEQ ID NO: 12242 - RNA, 414 nt, synthetic construct
  misc_feature 1..414: note = derived and/or modified sequence opt1 from anti-HIV_Chain
  source 1..414: mol_type = other RNA
caggtgcagctggtccagagcggcgccgaggtgcgcaagcccgggtccagcctcaaggtgtcctgcaagagctccggcgggaccttcagccggtacgtcgtgaactgggtgcgccaggccccgggccaggggctggagtggatgggcggcatcatccccatcttcgggatcgcgaagtacgcccagaagttccaggaccgggtcaccatgacggccgacgagtccaagaacaccgtgtacctggacttcagctccctccgcagcggcgacaccgccgtgtactactgcgcccgggaccgcggggacacccggctgctggactacggcgactacgaggacgagcgctactactacgggatggacgtctggggccagggcacgaccgtgaccgtgtccagcgcgtccaccaagggg

SEQ ID NO: 12243 - RNA, 417 nt, synthetic construct
  misc_feature 1..417: note = derived and/or modified sequence opt1 from anti-HIV_Chain
  source 1..417: mol_type = other RNA
caggtgcagctggtcgagagcggcgccgaggtgaagaagcccgggtccagcgtgaaggtctcctgcaaggccagcggcgggaccttcaacatcttcgcgttctcctgggtgcgccaggccccgggccaggggctcgagtggatgggcggcatcatccccatcttcgccagccccaactacgcccagcggttccaggggcgcgtgaccatcacggccgacgagtccaccagcaccgtccacatggagctgtccagcctgcggtccgaggacaccgcgatctactactgcgccaaggacgcccacatgcacatcgaggagccccgcgactacgactacatctggggcacgagcccgtactacttcgactactgggggcagggcaccctcgtgaccgtgtccagcgcctccaccaagggg

SEQ ID NO: 12244 - RNA, 417 nt, synthetic construct
  misc_feature 1..417: note = derived and/or modified sequence opt1 from anti-HIV_Chain
  source 1..417: mol_type = other RNA
caggtgcagctggtcgagagcggcgccgaggtgaagaagcccggggcctccgtgaaggtcagctgcaaggcgtccggctacaccttcaccagccacgacatcaactgggtgcgccaggccacggggcagggcctcgagtggatggggtggatgaacccgaactccggcgacaccggctacgcccacaagttccaggggcgggtgaccatgacccgcaacacgcccatcagcaccgcctacatggagctgtccagcctgcggtccgaggacaccgccgtctactactgcgcgcgcggccgggccaccagccgcaacacgccctgggcccactactacgactccagcgggtactacggcgccggggactactggggccagggcaccctcgtgaccgtgtccagcgcgtccaccaagggg

SEQ ID NO: 12245 - RNA, 417 nt, synthetic construct
  misc_feature 1..417: note = derived and/or modified sequence opt1 from anti-HIV_Chain
  source 1..417: mol_type = other RNA
caggtgcagatccgccagagcggccccgggctggtcaagccgctcgagaccctgtccctgagctgcatcgtgttcggcgggtccttcatcgcctaccactggacctggatccggcaggcgcccctcaagggcctggagtggatcggggacatcgaccagggcggcgacatcacgtacagcccctccctcaagagccgcgtgaccatgtccgtcgaccggagcaagtcccagttcagcctgaagctgtccagcgtgaccgccgccgacgccgccgtgtactactgcgtccgcgggcccccgaaccggtacgccgtgacctccttcacgagcggcacccaccgcgagcggtccagctactacttcgactactgggggcccggcaccctggtgaccgtctccagcgcgtccacgaagggg

SEQ ID NO: 12246 - RNA, 423 nt, synthetic construct
  misc_feature 1..423: note = derived and/or modified sequence opt1 from anti-HIV_Chain
  source 1..423: mol_type = other RNA
aacggcgggagcctgcgcctctcctgccgggtgagcggcttcgggttccacctgtacgagatgaactgggtccgccaggcccccggcaaggggctggagtggatctccagcatctccggcagcggcgagtccacccactacagcgactccatcaccgggcggttcagcatgtcccgcgacgaggccaaggacagcctctacctgcagatgaacaacctgcgggtggaggacacggcggtgtactactgcacccgcggcttctccatgggggacggcaccgggttcagcttcgacacctggggccggggcacgatggtcaccgtgtccagcgggctcgacaccgtgtccctggccagcaccaagggcccgtccgtcttccccctggccccctgcagccgcagcacgtccgacgcccggctcagc

SEQ ID NO: 12247 - RNA, 423 nt, synthetic construct
  misc_feature 1..423: note = derived and/or modified sequence opt1 from anti-HIV_Chain
  source 1..423: mol_type = other RNA
caggtgcagctggtccagagcggcgccgaggtgaagaagcccgggtccagcgtgaaggtctcctgcaaggccagcggcgggaccttctccacctacgcgatcagctgggtgcgccaggccccgggccaggggctcgagtggatgggcggcatcatcccctccttcagcatgtccaactacgcccaggacttccaggggcggctgacgatcaccgccgacgagagcacctccagcgtgtacatggagctgaactccctccgcagcgaggacaccgccgtctactactgcgcgcgggacttcccccgcttccaccggctggtgggcaactacgacttctggcgcgggacgctggaccggttctcctacatggacctctggggccgcgggaccgccgtgaccgtcagctccgccagcaccaagggc

SEQ ID NO: 12248 - RNA, 423 nt, synthetic construct
  misc_feature 1..423: note = derived and/or modified sequence opt1 from anti-HIV_Chain
  source 1..423: mol_type = other RNA
ctggtgcagctcgtcgagagcggcgggggcgtggtgcagcccgggcgctccctgcggctgagctgcgccgcctccggcttcaccttcagcacctacgcgatgcactgggtccgccaggcccccgggaagggcctcgagtgggtggccgtgatctcctacgacggcagcaacaagttctacgccgactccgtcaaggggcggttcacgatcagccgcgacaactccaagaacaccctgtacctgcagatgaacagcctccgggccgaggacaccgcggtgtactactgcgcccgccccaagttcctgcccggcgccgacatcgtggtcgtggtggccgcgacccccttcgactactgggggcagggcaacccggggcaccggctgctctccttccaccagggccccatcggcctgccgcccggg

SEQ ID NO: 12249 - RNA, 423 nt, synthetic construct
  misc_feature 1..423: note = derived and/or modified sequence opt1 from anti-HIV_HeavyChain
  source 1..423: mol_type = other RNA
atggagtggagcggcgtgttcatcttcctgctctccgtcaccgccggggtgcacagcgaggtgcagctggtcgagtccggcgggggcctggtgaagcccgggggcagcctccgcctgtcctgcgccgcgagcggctacaccttctccaactactggatcgggtgggtgcggcaggccccgggcaaggggctggagtggatcggcgacatctaccccgggggcaactacatccgcaacaacgagaagttcaaggacaagacgaccctcagcgccgacacctccaagaacaccgcctacctgcagatgaacagcctgaagacggaggacaccgccgtctactactgcggctccagcttcgggtccaactacgtgttcgcgtggttcacctactggggccaggggaccctcgtgacggtcagctcc

SEQ ID NO: 12250 - RNA, 423 nt, synthetic construct
  misc_feature 1..423: note = derived and/or modified sequence opt1 from anti-HIV_HeavyChain
  source 1..423: mol_type = other RNA
atggagtggagcggcgtgttcatcttcctgctctccgtcaccgccggggtgcacagccaggtgcagctggtccagtccggccccgacgtgaagaagccggggaccagcatgaagatgtcctgcaagacgagcggctacaccttctccaactactggatcgggtgggtgcgccaggcccccggccagggcctggagtggatcggggacatctaccccggcgggaactacatccggaacaacgagaagttcaaggacaagaccaccctcacggcggacaccagcacctccaccgcctacatgcagctgggcagcctgcgctccgaggacacggccgtctactactgcgggagctccttcggcagcaactacgtgttcgcctggttcacctactggggccaggggaccctcgtgaccgtctccagc

SEQ ID NO: 12251 - RNA, 429 nt, synthetic construct
  misc_feature 1..429: note = derived and/or modified sequence opt1 from anti-HIV_Chain
  source 1..429: mol_type = other RNA
caggtgttcgtccagctggtgcagagcggcgggggcctcgtgcagcccgggggctccgtccgcctgagctgcaccgcctccgggttcctgttcagcacctactccatgaactgggtgcggcaggccccgggcaagggcctcgagtgggtgagctccatcagcacgacctccaactacatctactacgcggacagcgtcaaggggcgcttcaccatctcccggagcaacggccaggggtccctgtacctgcagctcaacagcctgcgcgtggaggacaccgccgtgtactactgcgcccgggacacgaaggtcggcgcgccccgccaggactgctacgccatggacctgtgggggcagcgggaccacggccaccgcctcctgtccttccaccagggccccatcgggctgcccccgggcgccctcctgcag

SEQ ID NO: 12252 - RNA, 432 nt, synthetic construct
  misc_feature 1..432: note = derived and/or modified sequence opt1 from anti-HIV_Chain
  source 1..432: mol_type = other RNA
atcatcctgttcctcgtggccaccgccaccggcgtccacagcgacatccagatgacgcagtcccccagctccctgagcgcgtccgtgggggaccgcgtgaccatcacgtgccgggccagccagtccatcgaccgctacctgaactggtaccagcacaagcccggcaaggcccccaagctcctgatctacgccgccagcaacctgcacaccgacgtcccctcccggttcagcgggtccggcgcggggacctacttcaccctcaccatcaccagcctgcagcccgaggacttcgccacgtactactgccagcagtcccacagcccgtccttcggccaggagagctactccatcgccttcggccaggggacccgcctggagatcaagcggaccgtggccgcgcccagcgtgttcatcttcccgccctccgacgag

SEQ ID NO: 12253 - RNA, 432 nt, synthetic construct
  misc_feature 1..432: note = derived and/or modified sequence opt1 from anti-HIV_Chain
  source 1..432: mol_type = other RNA
ctgcagcagctccaggtgccccgcctgagcatgtggcgggtcttcaaggtggccgccgcgaccggcgcccagaccctgacggtggaggagccggggtccagcgtcaaggtgtcctgcaaggccagcggcgggtccagcaccgcctacggctactcctgggtgcgccaggcccccgggcagggcttcgagtggatgggccggatcatccccttctacgggatcatcacctacgcgcccaagttccagggccgcgtcaccatcacggccgaccggagcacctccaccgtgtacatggagctcaccagcctgacgttcgccgacaccgccctgttcttctgcgcgcgcgacttcggggacccgcggaacggctactacttcgactcctgggaccaggggctctggctgaccgtgagctccgccagcaccaagggc

SEQ ID NO: 12254 - RNA, 432 nt, synthetic construct
  misc_feature 1..432: note = derived and/or modified sequence opt1 from anti-HIV_Chain
  source 1..432: mol_type = other RNA
caggtgcgcctggagcagagcggcgtcgccatgcggaagcccggggcctccgtgaccctcagctgccaggcgtccggctacaacttcgtgaagtacatcatccactgggtccgccagaagccggggctgggcttcgagtgggtggggatgatcgacccctaccggggccgcccctggagcgcccacaagttccagggccggctgtccctcagccgcgacacctccatggagatcctgtacatgacgctgaccagcctcaagtccgacgacaccgccacctacttctgcgcccgggccgaggcggccagcgacatccactcccgccccatcatcctgacggggccgggcgagtacgggctggacctcgagcacatggactggacctggcggatcctgtgcctgctcgccgtggcccccggctgccacagccag

SEQ ID NO: 12255 - RNA, 435 nt, synthetic construct
  misc_feature 1..435: note = derived and/or modified sequence opt1 from anti-HIV_Chain
  source 1..435: mol_type = other RNA
atgttcctgttcctcgtggccggcgccaccggggtccagagccaggtgtacctggtgcccttcggcccggaggtcaagaagcccgggtccagcgtgaaggtgtcctgcaaggcgagcggcgactccttcaccagctccgtcatcacgtgggtgcgccaggcccccgggcagggccccgagtggatgggccgggtgatcccggtcctgggggtggccgcctacgcccagaagttctacggccgcgtgaccatcaccgcggacaccagctccaacacggcctacatggaggtcaacagcctccggttcgaggacaccgccgtgtactactgcgcccgcgagaccgggcggggcgggaacctggcgctgcgccagtacttcttcgactcctggggccagggcaccctcgtgacggtcagctcccccagcaccaagggg

SEQ ID NO: 12256 - RNA, 438 nt, synthetic construct
  misc_feature 1..438: note = derived and/or modified sequence opt1 from anti-HIV_Chain
  source 1..438: mol_type = other RNA
caggtgcagctgcaggagagcggccccgggctcgtcaagccgtccggcaccctgagcctgacctgcgccgtgtccggggccagcatctccagccgcaactggtggacgtgggtgcggcagccgcccggcaaggggctcgagtggatcggcgagatctacgagtccggcgcgaccaactacaaccccagcctgaagtcccgcgtcaccatcagcgtggacaagtccaagaaccagttcagcctgcggctcacctccgtgacggccgccgacaccgccgtctacttctgcgcccgcctgatgaccttcgggggcctgatcgggaccctcgactactggggccaggggacgctggtgaccgtgctgcagcccccgccccgggcgcaccgctaccacccccggaacctcctgcaggagcacctgtgcgcccgcgtcatgccc

SEQ ID NO: 12257 - RNA, 444 nt, synthetic construct
  misc_feature 1..444: note = derived and/or modified sequence opt1 from anti-HIV_HeavyChain
  source 1..444: mol_type = other RNA
atggagtggagcggcgtgttcatcttcctgctctccgtcaccgccggggtgcacagcgaggtgcagctggtcgagtccggcgggggcctggtgaagcccgggggcagcctccgcctgtcctgcgccgcgagcggctacaccttctccaactactggatcgggtgggtgcggcaggccccgggcaaggggctggagtggatcggcgacatctaccccgggggcaactacatccgcaacaacgagaagttcaaggacaagacgaccctcagcgccgacacctccaagaacaccgcctacctgcagatgaacagcctgaagacggaggacaccgccgtctactactgcggctccagcttcgggtccaactacgtgttcgcgtggttcacctactggggccaggggaccctcgtgacggtcagctccggcgagagcctgaagcccctg

SEQ ID NO: 12258 - RNA, 444 nt, synthetic construct
  misc_feature 1..444: note = derived and/or modified sequence opt1 from anti-HIV_HeavyChain
  source 1..444: mol_type = other RNA
atggagtggagcggcgtgttcatcttcctgctctccgtcaccgccggggtgcacagccaggtgcagctggtccagtccggccccgacgtgaagaagccggggaccagcatgaagatgtcctgcaagacgagcggctacaccttctccaactactggatcgggtgggtgcgccaggcccccggccagggcctggagtggatcggggacatctaccccggcgggaactacatccggaacaacgagaagttcaaggacaagaccaccctcacggcggacaccagcacctccaccgcctacatgcagctgggcagcctgcgctccgaggacacggccgtctactactgcgggagctccttcggcagcaactacgtgttcgcctggttcacctactggggccaggggaccctcgtgaccgtctccagcggcgagtccctgaagcccctg

SEQ ID NO: 12259 - RNA, 447 nt, synthetic construct
  misc_feature 1..447: note = derived and/or modified sequence opt1 from anti-HIV_Chain
  source 1..447: mol_type = other RNA
caggcccgcctggaccagtggggcaccgggctcctgaagcccagcgagaccctgtccctcaagtgcgccgtgttcggcgtcctgttcacggactacaactggacctgggtgcggcagagccccgggaagggcctggagtggatcgggcacctcgaccaccgcggcggcgggaactacaacccctccctggagagccgggtgaccatctccctggactacagcaaggcccagttctccctccacctgaagtccgtcaccgtggccgacacggccctgtactactgcgccggcgccgtgaaggggttctggttcgacgaggtctacaactggttcggccccggggtgcgcgagccctggctcccgagcccccagcccccgccccgggcgcaccgcagctccccctggcacccgccgccccgggcgcccctggtgaccgccaccgtcccc

SEQ ID NO: 12260 - RNA, 447 nt, synthetic construct
  misc_feature 1..447: note = derived and/or modified sequence opt1 from anti-HIV_Chain
  source 1..447: mol_type = other RNA
caggcccgcctggaccagtggggcaccgggctcctgaagcccagcgagaccctgtccctcaagtgcgccgtgttcggcgtcctgttcacggactacaactggacctgggtgcggcagagcccggggaagggcctggagtggatcgggcacctcgaccaccgcggcggcgggaactacaacccctccctggagagccgggtgaccatctccctggactacagcaaggcgcagttctccctccacctcaagagcgtcaccgtggccgacacggccctgtactactgcgccggcgccgtgaaggggctgtggttcgacgagacctacacctggttcggcccctggtcccaggggacccgcgtcacggtggcgagcgcctccaccaagggccccagcgtgttcccgctggccccctccagcaagtccaccagcggcacccgggacctgtcc

SEQ ID NO: 12261 - RNA, 447 nt, synthetic construct
  misc_feature 1..447: note = derived and/or modified sequence opt1 from anti-HIV_Chain
  source 1..447: mol_type = other RNA
gccgcccgcctggaccagtggggcaccgggctcgtgaagcccagcgagaccctgtccctgaagtgcgcggtcttcggcgtggacttcccggactacacgtggacctgggcccggcaggcccccgggaagggcctcgagtggatcgggcaccgcgaccaccggggcggcagctcctacaaccccagcctgtccgggcgcgccaccatcagcctggacacctccaaggcccagttcagcctccacatcaagtccgtgacggtcgcggacaccgccacctactactgcgccggcgccgtggcggggctgtggttcgaggacgcctacaactggttcggcccctggagccaggggaccctggtgacggtcgccgccgcctccaccaagggcccgagcgtgttccccctcgcgccctccagcaagtccaccagcggccacgcctccgtgctg

SEQ ID NO: 12262 - RNA, 450 nt, synthetic construct
  misc_feature 1..450: note = derived and/or modified sequence opt1 from anti-HIV_Chain
  source 1..450: mol_type = other RNA
ctggcccagctcgagcagagcggcgggggcgtggtcaagcccgggggctccctgcgcctgccgtgcgccgcgagcgggttcaccttcatcgactactacatggcctggatccggctcgcccccggcaagggcctggagtggctgtcctacatcagcaagaacggggactacaccaagtactccgagagcctcaagggccgcttcacgatctcccgggacaacgccaagaacctggtgatcctgcagctcaaccgcctgcgggccgacgacaccgcgatctacttctgcgcccgcgccgacgggctgacctacttcggcgagctcctgcagtacatcttcgacctgtgggggcagggcgcccgggtgatcgtcagctccgcgagcaccaagggcccctccgtgttccccctcgccccgagctccaagagcacgtccgggcacgccagcgtg

SEQ ID NO: 12263 - RNA, 459 nt, synthetic construct
  misc_feature 1..459: note = derived and/or modified sequence opt1 from anti-HIV_Chain
  source 1..459: mol_type = other RNA
caggtgcagctggtccagagcggcgccgaggtgaagaagcccggggcctccgtgaaggtcagctgcaaggtgtccggctacaccctcaccgagctgagcatccactgggtgcgccaggcgcccgggaagggcctggagtggatgggcgggttcgactccgaggacggcgaggccatctacaagcagaacttccaggggcgggtcacgatgaccgaggacaccagcaccgacacggcctacatggagctctcccgcctgcggagcgaggacaccgccgtgtactactgcgccaccgcggaccgcttcaaggtggcccaggacgagggcctgttcgtcatcttcgactactgggggcagggcaaccccgggcaccggctcctgtccctgcaccagggccccatcggcctgcccccggggaccctcccgcccaaggccacgagcggccacgccgcgcgccgg

SEQ ID NO: 12264 - RNA, 462 nt, synthetic construct
  misc_feature 1..462: note = derived and/or modified sequence opt1 from anti-HIV_Chain
  source 1..462: mol_type = other RNA
ctggtgcagctcgtccagagcggcgccgaggtgaagaagcccggggcctccgtgaaggtcagctgcaaggtgtccggctacagcctgaccgagctgtccatccactgggtgcgccaggcgccggggaagggcctcgagtggatgggcgggttcgacagcgaggacggcgaggccatctacaagcagaacttccaggggcgggtcaccatgacggaggacacctccaccgacaccgcctacatggagctgagccgcctgcggtccgaggacacggccgtgtactactgcgccaccgcggaccccttcaaggtggcccaggacgagggcctcttcgtcatcttcgactactgggggcagggcaccaccgggcaccgcctgctgagcctccaccagggcccccaccggctgtactccctgggcacgctcctgagccgcgcccccatcgtgcagacccacatggcc

SEQ ID NO: 12265 - RNA, 471 nt, synthetic construct
  misc_feature 1..471: note = derived and/or modified sequence opt1 from anti-HIV_Chain
  source 1..471: mol_type = other RNA
cagatccacctggtgcagagcggcaccgacgtcaagaagcccgggtccagcgtgaccgtgtcctgcaaggcctacggcgtcaacacgttcgggctctacgccgtgaactgggtgcgccaggcgccgggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgaccagtggtccgggctccaccacgacggcgtcatggccttcagctcccgcgggcagggcacgctgatcagcgtgtccgcggccagcaccaaggggcccagcgtgttccccctggccccctccagcaagtccacctacggcctcgcccacgtcctg

SEQ ID NO: 12266 - RNA, 477 nt, synthetic construct
  misc_feature 1..477: note = derived and/or modified sequence opt1 from anti-HIV_Chain
  source 1..477: mol_type = other RNA
cagcaccagctggtgccctgcgtcgccgaggtgcgcaagccgggcgccagcgtgaaggtctcctgcaaggtgagcgggtacaccctcaccgagatctccatgcactgggtgcggcaggcccccggcaaggggctggagtggatgggcgggttcgaccgcgaggacggcgagacgatctacgcccagaagttccagggccgggtcaccatgaccgaggacaccagcacggacaccgcctacatggagctgtccagcctccgctccgaggacaccgccgtgtactactgcgccaccacgtacctggcggtggtccccgacgggttcgacggctacagctccagctggtactggttcgacccctgggggcagggcaccctggtgaccgtgtccagcgcctccatgcaggggccgatgctcctgagccccaccggcacgctgctcccccgggcgcccctggtccagacccgcccgggcccc

SEQ ID NO: 12267 - RNA, 642 nt, synthetic construct
  misc_feature 1..642: note = derived and/or modified sequence opt1 from anti-HIV_LightChain
  source 1..642: mol_type = other RNA
gacatcgtgatcacccagagcaccaagttcatgtccacgagcgtcggcgaccgcgtgtccatcacgtgcaaggccagccaggacgtgtccaccgccgtcgcgtggtaccagcagaagcccgggcagagcccgaagctgctcatctactgggcctccacccggcacaccggcgtgcccgaccgcttcaccgggagcggctccgggaccgactacaccctgacgatcagccgggtgcaggccgaggacctggccctctactactgccagcagcactacaccaccccctggaccttcggcggcgggacgaagctggagatcaagcgcaccgtcgccgcgccctccttcgtgatcttcccgcccagcgacgagcagctgaagtccggcaccgccagcgtggtctgcctcctgaacaacttctacccccgggaggccaaggtgcagtggaaggtggacaacgccctgcagtccgggaacagccaggagtccgtcaccgagcaggacagcaaggactccacgtacagcctcagctccaccctgaccctgagcaaggcggactacgagaagcacaaggtgtacgcctgcgaggtgacccaccagggcctctccagccccgtcacgaagtccttcaaccgcggggagtgc

SEQ ID NO: 12268 - RNA, 651 nt, synthetic construct
  misc_feature 1..651: note = derived and/or modified sequence opt1 from anti-HIV_Chain
  source 1..651: mol_type = other RNA
cagagcgtgctgacccagcccccgtccgtcagcgccgcccccggccagaaggtgaccatctcctgcagcgggtccagctccaacatcggcaacaactacgtgctctggtaccagcagttccccgggacggcgcccaagctgctgatctacggcaacaacaagcgcccgagcgggatccccgaccggttctccggcagcaagtccggcaccagcgccaccctcgggatcaccggcctgcagacgggggacgaggccgactacttctgcgccacctgggactccggcctgagcgccgactgggtcttcgggggcggcaccaagctcaccgtgctgtcccagcccaaggcggcccccagcgtgacgctgttcccgccctccagcgaggagctccaggccaacaaggccaccctggtctgcctgatctccgacttctaccccggggcggtgaccgtggcctggaaggccgacagcagccccgtcaaggccggcgtggagaccacgaccccgtccaagcagagcaacaacaagtacgccgcgtccagctacctctccctgacccccgagcagtggaagtcccaccgcagctacagctgccaggtgacccacgaggggtccacggtcgagaagaccgtggcccccaccgagtgcagc

SEQ ID NO: 12269 - RNA, 657 nt, synthetic construct
  misc_feature 1..657: note = derived and/or modified sequence opt1 from anti-HIV_Chain
  source 1..657: mol_type = other RNA
gacatcgtgatgacccagagccccgactccctggccgtcagcctcggcgagcgggtgaccatgaactgcaagtccagccagtccctgctgtacagcacgaaccagaagaactacctcgcctggtaccagcagaagccggggcagtcccccaagctgctgatctactgggcgaacagcaccgagtccggcgtgcccgaccggttcagcgggtccggcagcgggaccgacttcaccctcacgatctccagcgtccaggccgaggacgtggccgtgtactactgccagcagtactactcctaccgcaccttcggcggcgggaccaagctggagatcaagcggaccgtcgccgcccccagcgtgttcatcttcccgccctccgacgagcagctcaagagcggcacggcgtccgtggtctgcctgctgaacaacttctacccccgcgaggccaaggtgcagtggaaggtggacaacgccctgcagagcgggaacagccaggagtccgtcaccgagcaggacagcaaggactccacctacagcctctccagcaccctgacgctgtccaaggccgactacgagaagcacaaggtgtacgcgtgcgaggtgacccaccagggcctcagctcccccgtcaccaagagcttcaaccgcggggagtgc

SEQ ID NO: 12270 - RNA, 753 nt, synthetic construct
  misc_feature 1..753: note = derived and/or modified sequence opt1 from anti-HIV_SingleChain
  source 1..753: mol_type = other RNA
atgcaggtccagctggagcagagcggcgccgaggtgaagaagcccggggcctccgtgaaggtgagctgccaggcgtccggctaccgcttcagcaacttcaccgtccactgggtgcggcaggccccggggcagcgcttcgagtggatgggctggatcaacccctacaacgggaacaaggagttctccgccaagttccaggaccgggtgaccttcacggccgacaccagcgccaacaccgcgtacatggagctccgctccctgcggagcgccgacaccgccgtctactactgcgcccgcgtgggcgagtggggctgggacgacagcccccaggacaactactacatggacgtgtgggggaagggcacgaccgtcatcgtgtcctccgggggcgggggcagcggcgggggcgggtccggcggcgggggcagcgacatcgagctgacccagtcccccgggaccctcagcctgtccccgggcgagcgggcgacgttcagctgccgctccagccacagcatccggtcccgccgggtggcctggtaccagcacaagcccgggcaggcgccccgcctggtcatccacggcgtgagcaaccgggcctccggcatcagcgaccgcttctccgggagcggctccgggaccgacttcaccctcaccatcacgcgggtggagcccgaggacttcgccctgtactactgccaggtctacggcgccagctcctacaccttcgggcagggcaccaagctggagcgcaag

SEQ ID NO: 12271 - RNA, 1338 nt, synthetic construct
  misc_feature 1..1338: note = derived and/or modified sequence opt1 from anti-HIV_LightChain
  source 1..1338: mol_type = other RNA
gaggtgaagctggaggagagcggcgggggcctcgtccagcccgggggctcccgcaagctgagctgcgccgcctccgggttcaccttcagctccttcggcatgcactgggtgcggcaggcgcccgagaagggcctggagtgggtggcctacatcagctccgggagctccaccctccactacgccgacacggtcaagggccgcttcaccatcagccgggacaaccccaagaacaccctgttcctgcagatgaagctcccctccctgtgctacgggctgctcggcagccgcaacctgtcccaccggctgctcagccagaacgacacccccatctgcctgacggtgtccagcgcctccaccaaggggccgagcgtgttccccctggccccctccagcaagagcacctccggcggcaccgcggccctcgggtgcctggtcaaggactacttccccgagccggtgacggtgagctggaactccggcgccctgaccagcggggtccacaccttccccgccgtgctccagtccagcggcctgtactccctgagctccgtggtcaccgtgcccagctccagcctcggcacgcagacctacatctgcaacgtgaaccacaagccctccaacaccaaggtcgacaagaaggtggagcccaagagctgcgacaagacccacacgtgcccgccctgccccgcgccggagctgctcgggggcccctccgtgttcctgttcccgcccaagcccaaggacaccctgatgatcagccgcacccccgaggtgacctgcgtcgtggtcgacgtgtcccacgaggaccccgaggtgaagttcaactggtacgtcgacggggtggaggtccacaacgccaagacgaagccccgggaggagcagtacaacagcacctaccgcgtggtgtccgtcctgaccgtgctccaccaggactggctgaacggcaaggagtacaagtgcaaggtgagcaacaaggccctgccggcccccatcgagaagaccatcagcaaggccaaggggcagccccgggagccccaggtctacacgctcccgccctcccgcgaggagatgaccaagaaccaggtgagcctgacctgcctggtgaagggcttctacccctccgacatcgcggtcgagtgggagagcaacggccagccggagaacaactacaagaccacgccgcccgtgctcgactccgacgggagcttcttcctgtactccaagctgaccgtggacaagagccggtggcagcagggcaacgtcttctcctgcagcgtgatgcacgaggccctccacaaccactacacccagaagtccctgagcctgtcccccgggaag

SEQ ID NO: 12272 - RNA, 1380 nt, synthetic construct
  misc_feature 1..1380: note = derived and/or modified sequence opt1 from anti-HIV_Chain
  source 1..1380: mol_type = other RNA
gaggtgcagctggtcgagagcggcgggggcctcgtgaagcccgggggctccctgcgcctgacctgcgtggccagcgggttcaccttctccgacgtctggctcaactgggtgcggcaggccccgggcaagggcctggagtgggtggggcgcatcaagagccggacggacggcgggaccaccgactacgcggcctccgtcaagggccgcttcaccatcagccgggacgactccaagaacacgctgtacctccagatgaacagcctgaagaccgaggacaccgccgtgtactcctgcaccacggacgggttcatcatgatccgcggcgtgagcgaggactactactactactacatggacgtctggggcaaggggaccaccgtgaccgtgtccagcgcctccacgaagggccccagcgtcttccccctggccccctccagcaagtccaccagcgggggcaccgcggccctcggctgcctggtgaaggactacttcccggagcccgtgaccgtctcctggaacagcggggccctgacgagcggcgtgcacaccttccccgccgtgctccagtccagcgggctgtactccctgagctccgtcgtgaccgtgcccagctccagcctcggcacccagacgtacatctgcaacgtcaaccacaagccgtccaacaccaaggtggacaagaaggtggagcccaagagctgcgacaagacccacacgtgcccgccctgcccggcgcccgagctgctcgggggcccctccgtcttcctgttcccgcccaagcccaaggacaccctgatgatcagccggacccccgaggtgacctgcgtcgtggtggacgtctcccacgaggaccccgaggtgaagttcaactggtacgtggacggcgtcgaggtgcacaacgccaagaccaagccgcgcgaggagcagtacaacagcacgtaccgggtggtctccgtgctgaccgtgctccaccaggactggctgaacgggaaggagtacaagtgcaaggtcagcaacaaggccctgcccgcccccatcgagaagaccatctccaaggccaagggccagccccgcgagccccaggtgtacaccctcccgcccagccgggacgagctgacgaagaaccaggtgtccctgacctgcctcgtcaaggggttctaccccagcgacatcgcggtggagtgggagagcaacggccagcccgagaacaactacaagaccaccccgcccgtgctggactccgacgggagcttcttcctgtactccaagctcacggtcgacaagagccgctggcagcagggcaacgtgttctcctgcagcgtgatgcacgaggccctgcacaaccactacacccagaagtccctgagcctctcccccggc

SEQ ID NO: 12273 - RNA, 1413 nt, synthetic construct
  misc_feature 1..1413: note = derived and/or modified sequence opt1 from anti-HIV_Chain
  source 1..1413: mol_type = other RNA
atggagtggagcggcgtgttcatgttcctgctctccgtcaccgccggggtgcacagccaggtgcagctgcagcagtccggccccgaggtcgtgaagccgggggccagcgtgaagatgtcctgcaaggcgagcggctacaccttcacgtcctacgtcatccactgggtgcgccagaagcccgggcagggcctggactggatcggctacatcaacccctacaacgacgggaccgactacgacgagaagttcaagggcaaggccaccctcaccagcgacacgtccaccagcaccgcctacatggagctgtccagcctgcggtccgaggacaccgccgtgtactactgcgcccgcgagaaggacaactacgcgacgggggcctggttcgcctactggggccaggggaccctcgtcaccgtgagctccgccagcaccaagggcccctccgtgttcccgctggcgcccagctccaagagcacgagcggcgggaccgccgccctgggctgcctcgtcaaggactacttccccgagcccgtgaccgtgtcctggaacagcggggccctgacctccggcgtccacacgttcccggccgtgctgcagagctccggcctctacagcctgtccagcgtggtcaccgtgccctccagctccctggggacccagacctacatctgcaacgtgaaccacaagcccagcaacacgaaggtcgacaagaaggtggagcccaagtcctgcgacaagacccacacgtgcccgccctgccccgcgcccgagttcgagggcgggccgagcgtgttcctcttcccgcccaagcccaaggacaccctgatgatctcccggacccccgaggtgacctgcgtcgtcgtggacgtgagccacgaggaccccgaggtcaagttcaactggtacgtggacggcgtggaggtccacaacgccaagaccaagccccgcgaggagcagtacaactccacctaccgggtggtgagcgtcctgacggtgctccaccaggactggctgaacgggaaggagtacaagtgcaaggtgtccaacaaggccctgcccgccagcatcgagaagaccatcagcaaggccaagggccagccgcgcgagccccaggtctacaccctcccgccctcccgggacgagctgaccaagaaccaggtgagcctgacgtgcctcgtgaagggcttctacccctccgacatcgcggtcgagtgggagagcaacgggcagcccgagaacaactacaagaccacgcccccggtgctggactccgacggcagcttcttcctgtactccaagctcaccgtggacaagagccgctggcagcaggggaacgtcttctcctgcagcgtgatgcacgaggccctgcacaaccactacacccagaagtccctgagcctctcccccggcaag

SEQ ID NO: 12274 - RNA, 645 nt, synthetic construct
  misc_feature 1..645: note = derived and/or modified sequence opt1 from anti-influenza_Fab
  source 1..645: mol_type = other RNA
atcgtgctgacccagagccccgccaccctctccgtcagccccggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagccggaggacttcgccgtgtactactgccagcactacagcaactggccgccccggctgaccttcggcgggggcaccaaggtcgagatcaagcgcacggtggccgccccctccgtgttcatcttcccgcccagcgacgagcagctgaagtccgggaccgcgagcgtcgtgtgcctcctgaacaacttctacccccgggaggccaaggtgcagtggaaggtcgacaacgccctgcagtccggcaacagccaggagtccgtgaccgagcaggacagcaaggacagcacctactccctcagctccacgctgaccctgagcaaggccgactacgagaagcacaaggtgtacgcctgcgaggtcacccaccaggggctctccagccccgtgaccaagtccttcaaccgcggcgagtgc

SEQ ID NO: 12275 - RNA, 681 nt, synthetic construct
  misc_feature 1..681: note = derived and/or modified sequence opt1 from anti-influenza_Fab
  source 1..681: mol_type = other RNA
gtgcagctggtcgagagcggcgggggcgtggtgcagcccgggaagtccccgcgcctcagctgcgccgcctccggccccaccttcagctcctacgcggtccactgggtgcggcaggcccccgggaagggcctggagtgggtgaccctgatcagctacgacggcgccaaccagtactacgccgactccgtcaaggggcgcttcacgatcagccgggacaactccaagaacaccgtgtacctccagatgaacagcctgcgccccgaggacaccgccgtgtactactgcgcggtcccgggccccgtgttcgggatcttcccgccctggtcctacttcgacaactggggccaggggatcctggtgaccgtcagctccgccagcacgaagggcccctccgtgttccccctcgcccccagctccaagagcacctccggcgggaccgccgcgctgggctgcctggtgaaggactacttccccgagccggtcaccgtgagctggaacagcggggccctcacgtccggcgtgcacaccttccccgccgtcctgcagagctccggcctgtacagcctctccagcgtggtgaccgtcccctccagctccctggggacccagacgtacatctgcaacgtgaaccacaagcccagcaacaccaaggtggacaagaaggtcgagccgaagtcctgc

SEQ ID NO: 12276 - RNA, 1515 nt, synthetic construct
  misc_feature 1..1515: note = derived and/or modified sequence opt1 from anti-influenza_Fab
  source 1..1515: mol_type = other RNA
gccggcagcaccgccaccctgtgcctcgggcaccacgcggtgcccaacggcacgatcgtcaagaccatcaccaacgaccagatcgaggtgaccaacgccacggagctggtgcagtccagctccaccggggagatctgcgacagcccgcaccagatcctggacggcaagaactgcaccctcatcgacgccctgctgggggacccccagtgcgacggcttccagaacaagaagtgggacctcttcgtcgagcgctccaaggcctacagcaactgctacccctacgacgtgcccgactacgcctccctgcggagcctggtggcgtccagcggcaccctcgagttcaacaacgagtccttcaactggacgggggtcacccagaacggcaccagctccgcctgcatccgccggagcaagaactccttcttcagccgcctgaactggctgacccacctcaacttcaagtacccggccctgaacgtgacgatgcccaacaacgagcagttcgacaagctgtacatctggggcgtgcaccaccccgggaccgacaaggaccagatcttcctctacgcccaggcgtccgggcggatcaccgtcagcaccaagcgctcccagcagacggtgagccccaacatcggcagccggccgcgcgtgcggaacatcccctcccgcatcagcatctactggaccatcgtcaagcccggcgacatcctgctgatcaactccaccgggaacctcatcgcgccccggggctacttcaagatccgcagcgggaagtccagcatcatgcggtccgacgccccgatcggcaagtgcaacagcgagtgcatcacccccaacggctccatccccaacgacaagcccttccagaacgtgaaccgcatcacgtacggggcctgcccgcggtacgtgaagcagaacaccctgaagctggccaccggcatgcgcaacgtccccgagaagcagacccgggggatcttcggcgccatcgccgggttcatcgagaacggctgggagggcatggtggacgggtggtacggcttccgccaccagaacagcgaggggcggggccaggccgccgacctcaagtccacgcaggccgcgatcgaccagatcaacgggaagctgaaccgcctgatcggcaagaccaacgagaagttccaccagatcgagaaggagttcagcgaggtggagggccggatccaggacctcgagaagtacgtcgaggacaccaagatcgacctgtggtcctacaacgccgagctgctcgtggccctggagaaccagcacaccatcgacctgacggacagcgagatgaacaagctgttcgagaagaccaagaagcagctccgcgagaacgccgaggacatggggaacggctgcttcaagatctaccacaagtgcgacaacgcctgcatcgggtccatccgcaacggcacctacgaccacgacgtgtaccgggacgaggcgctgaacaaccgcttccagatcaaggggagcggccggctcgtcccccgc

SEQ ID NO: 12277 - RNA, 657 nt, synthetic construct
  misc_feature 1..657: note = derived and/or modified sequence opt1 from anti-influenza_Fab
  source 1..657: mol_type = other RNA
caggtgcagctggtccagagcggcgggggcgtggtgcagcccgggcgctccctccggctgagctgcgccgcctccgagttcaccttccgcatgtacgcgacccactgggtccggcaggccccgggcaaggggctggagtgggtggccctcatcagctacgacggctccaacaagtactacgccgacagcgtgaagggccgcttcacgatctcccgggacaacagcatgaacaccgtctacctgcagatgaacaccctgcgccccgaggacaccgccgtgtactactgcgcgcgggacctcgggggctacttcatccgcgggatcatggacgtgtggggccaggggacgctggtcaccgtgtccagcgcctccaccaagggccccagcgtgttccccctggccccgtccagcggcgggaccgccgcgctcggctgcctggtcaaggactacttccccgagcccgtgacggtgtcctggaacagcggggccctgacctccggcgtccacaccttccccgccgtgctccagagctccggcctgtacagcctgagctccgtggtcaccgtgccgagctccagcctcgggacgcagacctacatctgcaacgtgaaccacaagccctccaacaccaaggtcgacaagcgggtggagcccaag

SEQ ID NO: 12278 - RNA, 642 nt, synthetic construct
  misc_feature 1..642: note = derived and/or modified sequence opt1 from anti-influenza_Fab
  source 1..642: mol_type = other RNA
gagctgcagatgacccagagcccctccagcgtgtccgccagcgtcggcgaccgcgtgaccatcacgtgccgggcctcccaggggatcagctcctggctcgcgtggtaccagcagaagccgggcaaggcccccaagctgctgatctacgccgccagctccctccagagcggggtgccctcccgcttcagcggctccgggagcggcaccgacttcaccctgaccatctccagcctgcagcccgaggacttcgccacgtactactgccagcaggcgaactccttcccgctcaccttcggcgggggcaccaaggtcgagatcaagcggaccgtggccgcccccagcgtgttcatcttcccgccctccgacgagcagctcaagagcgggacggccagcgtcgtgtgcctgctgaacaacttctacccccgcgaggcgaaggtgcagtggaaggtcgacaacgccctgcagtccggcaacagccaggagtccgtgaccgagcaggacagcaaggactccacctacagcctgtccagcaccctcacgctgtccaaggccgactacgagaagcacaaggtgtacgcctgcgaggtcacccaccaggggctgagctcccccgtgaccaagagcttcaaccggggcgagtgc

SEQ ID NO: 12279 - RNA, 993 nt, synthetic construct
  misc_feature 1..993: note = derived and/or modified sequence opt1 from anti-influenza_Fab
  source 1..993: mol_type = other RNA
gccgaccccggcgacaccatctgcatcgggtaccacgccaacaacagcaccgacacggtggacaccgtcctggagaagaacgtgaccgtgacccactccgtcaacctcctggaggacagccacaacggcaagctgtgcaagctcaaggggatcgcgccgctgcagctgggcaagtgcaacatcgccgggtggctcctgggcaaccccgagtgcgacctgctcctgacggcctccagctggtcctacatcgtggagaccagcaactccgagaacgggacctgctaccccggcgacttcatcgactacgaggagctgcgcgagcagctcagctccgtgagctccttcgagaagttcgagatcttccccaagaccagctcctggccgaaccacgagacgaccaagggcgtcaccgccgcctgcagctacgcgggggcctccagcttctaccggaacctgctgtggctcaccaagaagggctccagctaccccaagctgtccaagagctacgtgaacaacaaggggaaggaggtgctggtcctctggggcgtgcaccacccgcccacgggcaccgaccagcagagcctgtaccagaacgccgacgcctacgtgtccgtcgggagctccaagtacaaccgccggttcacccccgagatcgcggcccgccccaaggtgcgggaccaggccggccgcatgaactactactggaccctgctcgagcccggggacacgatcaccttcgaggccaccggcaacctgatcgccccctggtacgcgttcgccctgaaccggggcagcgggtccggcatcatcaccagcgacgccccggtgcacgactgcaacacgaagtgccagacgccccacggggccatcaactccagcctccccttccagaacatccaccccgtcaccatcggcgagtgcccgaagtacgtgcgctccaccaagctgcggatggccaccgggctgcgcaacatccccagcatccagtcccgg

SEQ ID NO: 12280 - RNA, 537 nt, synthetic construct
  misc_feature 1..537: note = derived and/or modified sequence opt1 from anti-influenza_Fab
  source 1..537: mol_type = other RNA
ggcctgttcggggccatcgccggcttcatcgagggcgggtggaccgggatgatcgacggctggtacggctaccaccaccagaacgagcaggggagcggctacgcggccgaccagaagtccacccagaacgccatcgacgggatcacgaacaaggtgaacagcgtcatcgagaagatgaacacccagttcaccgccgtgggcaaggagttcaacaacctcgagcgccggatcgagaacctgaacaagaaggtggacgacgggttcctggacatctggacctacaacgccgagctcctggtcctgctcgagaacgagcgcacgctggacttccacgactccaacgtgcggaacctgtacgagaaggtcaagagccagctcaagaacaacgcgaaggagatcggcaacggctgcttcgagttctaccacaagtgcgacgacgcctgcatggagtccgtgcgcaacgggacctacgactaccccaagtacagcgaggagtccaagctgaaccgggaggagatcgacggcgtgagcgggcgc

SEQ ID NO: 12281 - RNA, 642 nt, synthetic construct
  misc_feature 1..642: note = derived and/or modified sequence opt1 from anti-influenza_Apo
  source 1..642: mol_type = other RNA
cagagcgtgctgacccagcccccgtccgtcagcgtggcccccggccagaccgcccgcatcacgtgcgggggcaacgacatcgggcggaagtccgtgcactggaaccagcagaagcccggccaggcgcccgtcctcgtggtgtgctacgacagcgaccgcccgtccgggatccccgagcggttcagcggctccaacagcggcaacaccgccaccctgaccatctcccgcgtcgaggccggggacgaggccgactactactgccaggtgtgggacagctccagcgaccacgtgatcttcggcgggggcacgaagctgaccgtcctcgggcagcccaaggccgcgccctccgtgaccctgttcccgcccagctccgaggagctgcaggccaacaaggccaccctcgtgtgcctgatcagcgacttctaccccggcgccgtcacggtggcgtggaaggccgactccagccccgtgaaggccggcgtcgagaccaccaccccgtccaagcagagcaacaacaagtacgccgccagctcctacctgagcctcacgcccgagcagtggaagtcccaccggagctactcctgccaggtgacccacgaggggagcaccgtggagaagaccgtcgcgcccacggagtgctcc

SEQ ID NO: 12282 - RNA, 687 nt, synthetic construct
  misc_feature 1..687: note = derived and/or modified sequence opt1 from anti-influenza_Apo
  source 1..687: mol_type = other RNA
gaggtgcagctggtccagagcggcgccgaggtgaagaagcccggggcctccgtgaaggtcagctgcaaggcgtccggctacaccttcaccgactaccacatcaactgggtgcgccaggccccggggcagggcctcgagtggatggggtggatccaccccaacagcggcgacacgaactacgcccagaagttccagggctgggtgaccatgacccgggacaccgccatctccacggcctacatggaggtcaacgggctcaagagcgacgacaccgcggtgtactactgcgcccgcggcgggctggagccccggtccgtggactactactactacggcatggacgtctgggggcagggcaccaccgtgacggtgagctccgccagcaccaagggcccctccgtcttcccgctggcccccagctccaagagcacctccgggggcaccgcggccctggggtgcctggtgaaggactacttccccgagcccgtgacggtcagctggaactccggcgccctcaccagcggcgtgcacaccttcccggccgtgctgcagtccagcgggctgtacagcctctccagcgtcgtgaccgtgccctccagctccctgggcacgcagacctacatctgcaacgtcaaccacaagcccagcaacaccaaggtggacaagcgcgtggagcccaagtcctgc

SEQ ID NO: 12283 - RNA, 333 nt, synthetic construct
  misc_feature 1..333: note = derived and/or modified sequence opt1 from anti-influenza-A_kappa_LightChain_V-Region
  source 1..333: mol_type = other RNA
gacatcgtgatgacccagagccccgactccctggccgtcagcctcggcgcccgcgcgaccatcaactgcaagtccagccagtccgtgacgttcaactacaagaactacctggcctggtaccagcagaagcccgggcagccgcccaaggtgctgatctactgggccagcgcccgggagtccggcgtccccgaccgcttcagcgggtccggcagcgggaccgacttcaccctcaccatctccagcctgcaggccgaggacgtggcggtgtactactgccagcagcactaccggacgccgcccaccttcggccagggcaccaaggtcgagatcaag

SEQ ID NO: 12284 - RNA, 333 nt, synthetic construct
  misc_feature 1..333: note = derived and/or modified sequence opt1 from anti-influenza-A_kappa_LightChain_V-Region
  source 1..333: mol_type = other RNA
gacatcgtgatgacccagagccccgactccctggccgtcagcctcggcgagcgcgccaccatcaactgcaagtccagccagtccgtgagctccaacaacaagaactacctggcgtggtaccagcagaagcccgggcagccgcccaaggtgctgatctactgggccagcgcccgggagtccggcgtccccgaccgcttcagcgggtccggcagcgggacggacttcaccctcaccatctccagcctgcaggccgaggacgtggccgtgtactactgccagcagcactaccggaccccgcccacgttcggccagggcaccaaggtcgagatcaag

SEQ ID NO: 12285 - RNA, 333 nt, synthetic construct
  misc_feature 1..333: note = derived and/or modified sequence opt1 from anti-influenza-A_kappa_LightChain_V-Region
  source 1..333: mol_type = other RNA
gacatcgtgatgacccagagccccgactccctggccgtcagcctcggcgagcgcgccaccatcaactgccggtccagccagtccgtgagctccaacaacaagaacttcctggcgtggtaccaggagaagcccgggcagccgcccaaggtgctgatctactgggccagcgcccgcgagtccggcgtccccgaccggttcagcgggtccggcagcgggacggacttcaccctcaccatctccggcctgcaggccgaggacgtggccgtgtactactgccagcagcactaccgcaccccgcccacgttcggccaggggaccaaggtcgagatcaag

SEQ ID NO: 12286 - RNA, 333 nt, synthetic construct
  misc_feature 1..333: note = derived and/or modified sequence opt1 from anti-influenza-A_kappa_LightChain_V-Region
  source 1..333: mol_type = other RNA
gacatcgtgatgacccagagccccgactccctggccgtcagcctcggcgagcgcgccaccatcaactgcaagtccagccagtccgtgacgttcaactacaagaactacctggcgtggtaccagcagaagcccgggcagccgcccaagctgctcatctactgggccagcacccgggagtccggcgtgcccgaccgcttcagcgggtccggcagcgggaccgacttcaccctgacgatctccagcctgcaggccgaggacgtcgccgtgtactactgccagcagcactaccggaccccgcccaccttcggccagggcaccaaggtggagatcaag

SEQ ID NO: 12287 - RNA, 339 nt, synthetic construct
  misc_feature 1..339: note = derived and/or modified sequence opt1 from anti-influenza-A_kappa_LightChain_V-Region
  source 1..339: mol_type = other RNA
gacatcgtgatgacccagagccccgactccctggccgtcagcctcggcgagcgcgccaccatcaactgcaagtccagccagtccgtgctgtacagctccaacaacaagaactacctggcgtggtaccagcagaagcccgggcagccgcccaagctcctgatctactgggccagcacgcgggagtccggcgtgcccgaccgcttcagcgggtccggcagcgggaccgacttcaccctgaccatctccagcctccaggccgaggacgtcgccgtgtactactgccagcagtactactccacgccgcccaccttcggccagggcaccaaggtggagatcaag

SEQ ID NO: 12288 - RNA, 333 nt, synthetic construct
  misc_feature 1..333: note = derived and/or modified sequence opt1 from anti-influenza-A_kappa_LightChain_V-Region
  source 1..333: mol_type = other RNA
gacatccagatgacccagagccccgactccctggccgtgagcctcggcgcccgcgcgaccatcaactgcaagtccagccagtccgtcacgttcaactacaagaactacctggcctggtaccagcagaagcccgggcagccgcccaaggtgctgatctactgggccagcgcccgggagtccggcgtgcccgaccgcttcagcgggtccggcagcgggaccgacttcaccctcaccatctccagcctgcaggccgaggacgtcgcggtgtactactgccagcagcactaccggacgccgcccaccttcggccagggcaccaaggtggagatcaag

SEQ ID NO: 12289 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagctacgacgggtccaacaagtactacgccgacagcgtcaagggccggttcaccatctcccgcgacaacagcaagaacacgctctacctgcagatgaactccctgcgggccgaggacaccgccgtgtactactgcgcgaaggacagccagctccgctccctgctgtacttcgactggctcagccaggggtacttcgactactggggccaggggaccctggtgaccgtctccagc

SEQ ID NO: 12290 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtccagagcggcgggggcgtggtgcagcccgggcgctccctccggctgagctgcgtcgcctccggcttcaccttcagcacctacgccatgcactgggtgcgccaggcgccggggcggggcctggagtgggtggccgtcatctcctacgacggcaactacaagtactacgccgacagcgtgaaggggcgcttctccatcagccgggacaactccaacaacacgctccacctggagatgaacaccctgcgcaccgaggacaccgccctctactactgcgccaaggacagccagctgcggtccctgctctacttcgagtggctgagccagggctacttcgacccctgggggcagggcacgctggtgaccgtctccagc

SEQ ID NO: 12291 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtccagagcggcgggggcgtggtgcagcccgggcgctccctccggctgagctgcgccgcctccggcttcaccttcagcacctacgggatgcactgggtccgccaggcgccgggcaagggcctggagtgggtggccgtgatctcctacgacgggaactacaagtactacgccgacagcgtcaagggccggttcacgatctcccgcgacaacagcaagaacaccctctacctggagatgaactccctgcggaccgaggacaccgccctctactactgcgccaaggacagccagctgcgctccctgctctacttcgactggctgagccaggggtacttcgaccactggggccaggggacgctggtgaccgtgtccagc

SEQ ID NO: 12292 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtccagagcggcgggggcgtggtgcccccggggcgctccctccggctgagctgcgccgcctccggcttcaccttcagcacctacgggatgcactgggtccgccaggcgcccggcaagggcctggagtgggtggccgtgatctcctacgacgggaactacaagtactacgccgacagcgtccggggccgcttcacgatctcccgggacaacagcaagaacaccctcaacctggacatgaactccctgcgcaccgaggacaccgccctctactactgcgccaaggacagccagctgcggtccctgctctacttcgactggctgagccaggggtacttcgaccactggggccaggggacgctggtgaccgtgtccagc

SEQ ID NO: 12293 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccgtgatctcctacgacgccaactacaagtactacgccgacagcgtcaagggccggttcacgatctcccgcgacaacagcaagaacaccctctacctgcagatgaactccctgcgggcggaggacaccgccgtgtactactgcgccaaggacagccagctccgctccctgctgtacttcgagtggctcagccaggggtacttcgactactggggccaggggaccctggtgacggtctccagc

SEQ ID NO: 12294 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccgtgatctcctacgacggcaactacaagtactacgccgacagcgtcaaggggcggttcacgatctcccgcgacaacagcaagaacaccctctacctgcagatgaactccctgcgggccgaggacaccgcggtgtactactgcgccaaggacagccagctccgctccctgctgtacttcgagtggctcagccagggctacttcgacccctgggggcagggcaccctggtgacggtctccagc

SEQ ID NO: 12295 - RNA, 387 nt, synthetic construct
  misc_feature 1..387: note = derived and/or modified sequence opt1 from anti-influenza-A_HeavyChain_V-Region
  source 1..387: mol_type = other RNA
caggtgcagctggtccagagcggcgggggcgtggtgcagcccgggcgctccctccggctgagctgcgtcgcctccggcttcaccttcagcacctacgccatgcactgggtgcgccaggcgccggggcggggcctggagtgggtggccgtcatctcctacgacggcaactacaagtactacgccgacagcgtgaaggggcgcttctccatcagccgggacaactccaacaacacgctccacctggagatgaacaccctgcgcaccgaggacaccgccctctactactgcgccaaggacagccagctgcggtccctgctctacttcgagtggctgagccagggctacttcgacccctgggggcagggcacgctggtgaccgtcacctcc

SEQ ID NO: 12296 - RNA, 330 nt, synthetic construct
  misc_feature 1..330: note = derived and/or modified sequence opt1 from anti-influenza-A_LightChain_V-Region
  source 1..330: mol_type = other RNA
aacttcatgctgacccagcccccgagcgcctccggcacccccgggcagcgcgtgacgatcagctgctccggcagctccagcaacatcgggggcaacaccgtccactggttccagcagctccccgggaccgcccccaagctgctgatctacaccaactccctccggccgagcggcgtgcccgaccgcttctccggcagcaagtccgggacgagcgcgtccctggccatcagcggcctgcagtccgaggacgaggccgactactactgcgccgcctgggacgacagcctcaacgggcaggtcttcggcgggggcaccaagctgaccgtgctg

SEQ ID NO: 12297 - RNA, 390 nt, synthetic construct
  misc_feature 1..390: note = derived and/or modified sequence opt1 from anti-influenza-A_HeavyChain_V-Region
  source 1..390: mol_type = other RNA
caggtgcagctgctcgagagcggcgggggcgtcgtgcagcccgggcgctccctgcggctgagctgcgccgcctccggcttcaccttcagcaactacgggatgcactgggtgcgccaggcgccgggcaagggcctcgagtgggtcgccatcatctccttcgacgggagcaagaagtactacgccaactccgtgaagggccggagcaccatctcccgcgacaacagcaagaacacgctgtccctgcagatgaacagcctcgggcccgaggacaccgccctgtactactgcgccaagctgccctccccctactacttcgacagccggttcgtgtgggtcgcggcctccgccttccacttctggggccaggggatcctcgtgaccgtgagctcc

SEQ ID NO: 12298 - RNA, 132 nt, synthetic construct
  misc_feature 1..132: note = derived and/or modified sequence opt1 from anti-influenza_Chain
  source 1..132: mol_type = other RNA
aacgtgcccgagtggagctacatcgtcgagaaggccaacccggccaacgacctgtgctaccccggcaacttcaacgactacgaggagctgaagcacctcctgtcccgcatcaaccacttcgagaagatccag

SEQ ID NO: 12299 - RNA, 162 nt, synthetic construct
  misc_feature 1..162: note = derived and/or modified sequence opt1 from anti-influenza_Chain
  source 1..162: mol_type = other RNA
agcggccgcctggtgccccgggggtccccgggcagcgggtacatccccgaggccccgcgcgacggccaggcctacgtccggaaggacggggagtgggtgctcctgtccaccttcctgggcaagcccatccccaaccccctcctgggcctggacagcaccggg

SEQ ID NO: 12300 - RNA, 291 nt, synthetic construct
  misc_feature 1..291: note = derived and/or modified sequence opt1 from anti-influenza_Chain
  source 1..291: mol_type = other RNA
atgagcctgctcaccgaggtggagacccccatccgcaacgagtggggctgccggtgcaacgggtccagcgacccgctggccatcgccgcgaacatcatcggcatcctgcacctcatcctgtggatcctggaccgcctcttcttcaagtgcatctaccggcgcttcaagtacgggctgaagggcgggccctccacggagggcgtccccaagagcatgcgggaggagtaccgcaaggagcagcagtccgccgtggacgccgacgacggccacttcgtgagcatcgagctggag

SEQ ID NO: 12301 - RNA, 300 nt, synthetic construct
  misc_feature 1..300: note = derived and/or modified sequence opt1 from anti-influenza_Chain
  source 1..300: mol_type = other RNA
atgaacaacgccaccttcaactgcaccaacatcaaccccatcacgcacatccgcggcagcatcatcatcaccatctgcgtgtccctgatcgtcatcctcatcgtgttcgggtgcatcgccaagatcttcatcaacaagaacaactgcaccaacaacgtgatccgggtccacaagcgcatcaagtgcccggactgcgagcccttctgcaacaagcgggacgacatcagcacgccccgcgcgggcgtggacatcccctccttcatcctgccggggctgaacctcagcgagggcacccccaac

SEQ ID NO: 12302 - RNA, 300 nt, synthetic construct
  misc_feature 1..300: note = derived and/or modified sequence opt1 from anti-influenza_Chain
  source 1..300: mol_type = other RNA
gagctgacccagagcccctccagcctctccgccagcgtgggcgactccgtcaccatcacgtgccgcaccagcgagcggatctccacctacctgaactggtaccagcagaagccggggaaggcgccccgcctgctcgtgagcggcgcctccaccctgcagggcggggtgcccagccggttctccgggagcggctccggcacggccttcaccctgaccatcaacagcctccagcccgaggacttcgccacctactactgccagcagtcctacagcacgccgctgaccttcgggggcgggacc

SEQ ID NO: 12303 - RNA, 300 nt, synthetic construct
  misc_feature 1..300: note = derived and/or modified sequence opt1 from anti-influenza_Chain
  source 1..300: mol_type = other RNA
atgacccagagcccctccagcatgtccgtgagcctgggcgacaccgtctccatcacgtgccacgccagccaggacatctccgggcacatcggctggctccagcagaagccgggcaagagcttcaaggggctgatctaccacgggaccaacctggaggacggcgtgccctcccgcttcagcggctccgggagcggcgccgacttctccctcaccatcagctccctggagagcgaggacttcgcggactactactgcgtgcagtacgtccagttcccctggaccttcgggggcgggacgaag

SEQ ID NO: 12304 - RNA, 306 nt, synthetic construct
  misc_feature 1..306: note = derived and/or modified sequence opt1 from anti-influenza_Chain
  source 1..306: mol_type = other RNA
gacatccaggtgacccagagcccctccagcctgtccgccagcgtcggcgaccgcgtgaccatctcctgccgggcccagagcctctccagctacctgcactggtaccagcagaagcccgggcagccgcccaagctgctcatctacgcggccacgaccctgcagtccggcgtgcccagccgcttctccgggagcggctccgggaccgacttcaccctgacgatcagcaccttccaggccgaggacgtcgccacctactactgccagcagtcccggaccttcggccagggcacgaaggtggagatcaag

SEQ ID NO: 12305 - RNA, 306 nt, synthetic construct
  misc_feature 1..306: note = derived and/or modified sequence opt1 from anti-influenza_Chain
  source 1..306: mol_type = other RNA
gacatccagatgacccagagcccctccagcctgtccgccagcgtgggcgaccgcgtcaccatctcctgccgggcccagagcctctccagctacctgcactggtaccagcagaagcccgggcagccgcccaagctgctcatctacgcggccacgaccctgcagtccggcgtgcccagccgcttctccgggagcggctccgggaccgacttcaccctgacgatcagcaccttccaggccgaggacgtggccacctactactgccagcagtcccggaccttcggccagggcacgaaggtcgagatcaag

SEQ ID NO: 12306 - RNA, 309 nt, synthetic construct
  misc_feature 1..309: note = derived and/or modified sequence opt1 from anti-influenza_Chain
  source 1..309: mol_type = other RNA
gacatccagatcacccagagcccctccagcctgtccgccagcgtgggcgaccgcgtcaccatcacgtgccggacctcccagagcctctccagctacctgcactggtaccagcagaagccggggaaggcccccaagctgctcatctacgcggcctccagcctgcagtccggcgtgcccagccgcttctccgggagcggctccgggaccgacttcaccctgacgatcagctccctccagcccgaggacttcgccacctactactgccagcagagccggaccttcggccagggcaccaaggtggagatcaag

SEQ ID NO: 12307 - RNA, 309 nt, synthetic construct
  misc_feature 1..309: note = derived and/or modified sequence opt1 from anti-influenza_Chain
  source 1..309: mol_type = other RNA
gacatccagatgacccagagcccctccagcctgtccgccagcgtgggcgaccgcgtcaccatcacgtgccggacctcccagagcctctccagctacctgcactggtaccagcagaagccggggaaggcccccaagctgctcatctacgcggcctccagcctgcagtccggcgtgcccagccgcttctccgggagcggctccgggaccgacttcaccctgacgatcagctccctccagcccgaggacttcgccacctactactgccagcagagccggaccttcggccagggcaccaaggtggagatcaag

SEQ ID NO: 12308 - RNA, 309 nt, synthetic construct
  misc_feature 1..309: note = derived and/or modified sequence opt1 from anti-influenza_Chain
  source 1..309: mol_type = other RNA
gacatccaggtgacccagagcccctccagcctgtccgccagcgtcggcgaccgcgtgaccatctcctgccgggccagccagcgcctcaactcctacctgcactggtaccagcagacgccggggcaggcgcccaagctgctcatctacgccaccagcaccctgcagtccggcgtgagcccccggttctccgggagcggctccgggaccgacttcacgctgaccatcagctccctccagcccgaggacgtcgccacctactactgccagctgagccgcaccttcggccacggcacgaaggtggagatcaag

SEQ ID NO: 12309 - RNA, 309 nt, synthetic construct
  misc_feature 1..309: note = derived and/or modified sequence opt1 from anti-influenza_Chain
  source 1..309: mol_type = other RNA
gacatccagatgacccagagcccctccagcctgtccgccagcgtgggcgaccgcgtcaccatctcctgccgggccagccagcgcctcaactcctacctgcactggtaccagcagacgccggggcaggcgcccaagctgctcatctacgccaccagcaccctgcagtccggcgtgagcccccggttctccgggagcggctccgggaccgacttcacgctgaccatcagctccctccagcccgaggacgtggccacctactactgccagctgagccgcaccttcggccacggcacgaaggtcgagatcaag

SEQ ID NO: 12310 - RNA, 309 nt, synthetic construct
  misc_feature 1..309: note = derived and/or modified sequence opt1 from anti-influenza_Chain
  source 1..309: mol_type = other RNA
gacatccaggtgacccagagcccctccagcctgtccgccagcgtcggcgaccgcatcaccatctcctgccggacgagccagtccctccgcagctacctgcactggtaccagcagaagccggggaaggcccccaagctgctcatctacgcgtccagcaccctgcagtccggcgtgcccagccggttctccgggagcggctccgggaccgacttcaccctgacgatcagcaacctccagcccgaggacttcgccacctactactgccagctgtcccgcaccttcggccagggcaccaaggtggagatcaag

SEQ ID NO: 12311 - RNA, 309 nt, synthetic construct
  misc_feature 1..309: note = derived and/or modified sequence opt1 from anti-influenza_Chain
  source 1..309: mol_type = other RNA
gacatccagatgacccagagcccctccagcctgtccgccagcgtgggcgaccgcatcaccatctcctgccggacgagccagtccctccgcagctacctgcactggtaccagcagaagccggggaaggcccccaagctgctcatctacgcgtccagcaccctgcagtccggcgtccccagccggttctccgggagcggctccgggaccgacttcaccctgacgatcagcaacctccagcccgaggacttcgccacctactactgccagctgtcccgcaccttcggccagggcaccaaggtggagatcaag

SEQ ID NO: 12312 - RNA, 309 nt, synthetic construct
  misc_feature 1..309: note = derived and/or modified sequence opt1 from anti-influenza_Chain
  source 1..309: mol_type = other RNA
gacatccagatgacccagagcccctccagcctgtccgccagcgtgggcgaccgcgtcaccatcacgtgccggacctcccagagcctctccagctacacccactggtaccagcagaagccggggaaggcccccaagctgctgatctacgcggcctccagccgcctctccggcgtgcccagccggttctccgggagcggctccgggaccgacttcacgctgaccatcagctccctgcagcccgaggacttcgccacctactactgccagcagagccgcaccttcggccagggcacgaaggtggagatcaag

SEQ ID NO: 12313 - RNA, 309 nt, synthetic construct
  misc_feature 1..309: note = derived and/or modified sequence opt1 from anti-influenza_Chain
  source 1..309: mol_type = other RNA
gacatccagatgacccagagcccctccagcctgtccgccagcgtgggcgaccgcgtcaccatcacgtgccggacctcccagagcctctccagctacacccactggtaccagcagaagccggggaaggcccccaagctgctgatctacgcggcctccagccgcggctccggggtgcccagccggttctccggcagcgggtccggcaccgacttcacgctcaccatcagctccctgcagcccgaggacttcgccacctactactgccagcagagccgcaccttcggccaggggacgaaggtggagatcaag

SEQ ID NO: 12314 - RNA, 309 nt, synthetic construct
  misc_feature 1..309: note = derived and/or modified sequence opt1 from anti-influenza_Chain
  source 1..309: mol_type = other RNA
gacatccagatgacccagagcccctccagcctgtccgccagcgtgggcgaccgcgtcaccatcacgtgccggacctcccagagcctctccagctacgaccactggtaccagcagaagccggggaaggcccccaagctgctgatctacgcggcctccagccgcctctccggcgtgcccagccggttctccgggagcggctccgggaccgacttcaccctgacgatcagctccctgcagcccgaggacttcgccacctactactgccagcagagccgcaccttcggccagggcaccaaggtggagatcaag

SEQ ID NO: 12315 - RNA, 318 nt, synthetic construct
  misc_feature 1..318: note = derived and/or modified sequence opt1 from anti-influenza_Chain
  source 1..318: mol_type = other RNA
gagatcgtgatgacccagagccccgacaccctgtccgtcagcccgggcgagcgcgccacgctctcctgccgggccagccagtccgtgaaccgccggctggcgtggtaccagcagaagcccgggcaggcgccccgcctgctcatccacgacgccagcacccgggccaccggcatccccgcccgcttctccgggagcggctccgggaccgagttcacgctgaccatcagctccctgcagagcgaggacttcgccgtgtactactgccagcagtacgacaactggctctccttcggccagggcacccggctggagatcaag

SEQ ID NO: 12316 - RNA, 318 nt, synthetic construct
  misc_feature 1..318: note = derived and/or modified sequence opt1 from anti-influenza_Chain
  source 1..318: mol_type = other RNA
gacatccagctgacccagagcccctccagcctctccgccagcgtgggcgaccgcgtcaccatcacgtgccgggcctcccaggggatcctgaactgcctggcgtggtaccagcagaagccgggcaaggtgcccaacctcctgatgtacgccgccagcaccctgcagtccggggtgcccagccgcttctccggcagcgggttcggcaccgacttcaccctcacgatctccagcctgcagcccgaggacgtcgccacctactactgccagacctacggcggggtgtccaccttcggcgggggcacgaaggtggagatccgg

SEQ ID NO: 12317 - RNA, 318 nt, synthetic construct
  misc_feature 1..318: note = derived and/or modified sequence opt1 from anti-influenza_Chain
  source 1..318: mol_type = other RNA
agctacgtgctgacccagcccccgtccgtcagcgtggcccccggccagaccgcccgcatctcctgcgggggcagcaacatcgggggcaagtccgtgcactggtaccagcagaagcccgggcaggcgcccgtcctcgtggtgtacgacgacagcggccggccgtccggcatccccgagcgcttcagcgggtccaacagcggcgacacggccaccctgaccatctcccgggtcgaggccggggacgaggccgactacttctgccaggtgtgggacaacttcggcggggtgttcggcaccggcacgaaggtcaccgtgctg

SEQ ID NO: 12318 - RNA, 318 nt, synthetic construct
  misc_feature 1..318: note = derived and/or modified sequence opt1 from anti-influenza_Chain
  source 1..318: mol_type = other RNA
gacatccagatgacccagagcccctccagcctgtccgccagcgtgggcgaccgcgtcaccatcacgtgccggacctcccagagcatctccagctacctcaactggtaccagcagaagccggggaaggcccccaagctgctgatctacgcggcctccagcctccagtccggcgtgcccagccgcttctccgggagcggctccgggaccgacttcaccctgacgatcagcggcctgcagcccgaggacttcgccacctactactgccagcagtcctacagcatgccggccttcggccaggggaccaagctcgagatcaag

SEQ ID NO: 12319 - RNA, 318 nt, synthetic construct
  misc_feature 1..318: note = derived and/or modified sequence opt1 from anti-influenza_Chain
  source 1..318: mol_type = other RNA
gacatccagatgacccagagccccctgtccgtgagcgtctccgtgggcgaccgcgtgaccatcgcctgccgggccagccagtccatcgacaagttcctcaactggtaccagcagaagccggggaaggcgcccaagctgctgatctacggcgccagcaacctccactccggggcccccagccgcttctccgccagcggctccgggacggacttcaccctgaccatcaccaacatccagacggaggacttcgccacctacctgtgccagcagagcttctccgtccccgcgttcggcggcgggaccaaggtggagatcaag

SEQ ID NO: 12320 - RNA, 318 nt, synthetic construct
  misc_feature 1..318: note = derived and/or modified sequence opt1 from anti-influenza_Chain
  source 1..318: mol_type = other RNA
gacatccagatgacccagagcccgtccagcctgtccgccagcgtgggcgaccgcgtcaccatcacgtgccgggcctcccagagcatctccacctacctcaactggtaccagaagcgcccggggaaggcgcccaagctgctggtgtacggcgccagcaccctccagtccggggtgcccagccggttctccggcagcgggtccggcaccgacttcacgctgaccatcgccagcctgcagcccgaggactccgccacctactactgccagcagacctacagcatccccctcttcggccaggggacgcgcctggagatcaag

SEQ ID NO: 12321 - RNA, 318 nt, synthetic construct
  misc_feature 1..318: note = derived and/or modified sequence opt1 from anti-influenza_Chain
  source 1..318: mol_type = other RNA
gacatccagatgacccagagcccgtccagcctgtccgccagcgtgggcgaccgcgtcaccatcacgtgccgggcctcccagagcatctccacctacctcaactggtaccagaagcgcccggggaaggcgcccaagctgctggtgtacggcgccagctccctccagagcggggtgccctcccggttcagcggctccgggagcggcaccgacttcaccctgacgatcgcctccctgcagcccgaggacagcgccgtctactactgccagcagacctactccatccccctcttcggccaggggacccgcctggagatcaag

SEQ ID NO: 12322 - RNA, 318 nt, synthetic construct
  misc_feature 1..318: note = derived and/or modified sequence opt1 from anti-influenza_Chain
  source 1..318: mol_type = other RNA
gacatccagatgacccagagcccctccagcctgtccgccagcgtgggcgaccgcgtcaccatcacgtgccgggcctcccagagcatctcccgctacctcaactggtaccagcagaagccggggaaggcgcccaagctgctgatctacggcgccagcaccctccagaacggggccccctcccggttcagcggctccgggagcggcaccgacttcaccctgacgatctccagcctgcagcccgaggactccgccacctacctctgccagcagagctactccgtgccggccttcggcgggggcaccaaggtggaggtcaag

SEQ ID NO: 12323 - RNA, 318 nt, synthetic construct
  misc_feature 1..318: note = derived and/or modified sequence opt1 from anti-influenza_Chain
  source 1..318: mol_type = other RNA
ggcatccagatgacccagagcccctccagcctgtccgccagcgtgggggaccgcgtcaccatcacgtgccgggcctcccagagcatctcccgctacctcaactggtacctgcagaagccgggcaaggcgcccaagctgctcatcagcggggcctccagcctgcagtccggcgtgcccagccggttctccgggaccggcagcggcaccgagttcaccctgacgatctccagcctccagcccgaggacttcgccacctactactgccagcagaccttctccatcccgctgttcgggcagggcaccaaggtggagatcaag

SEQ ID NO: 12324 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtctccatcacgtgccaggccagccaggacatctcccggtacctcaactggtaccagcagaagccgggggaggcgcccaagctgctgatctacgacgccagcaacctcgagaccggcgtgccctcccgcttcagcgggtccggcagcgggaccgacttcaccttcaccatctccagcctgcagcccgaggacatcgccacgtacttctgccagcagtacggctacctgccgctcaccttcggccccgggaccaaggtggactccaag

SEQ ID NO: 12325 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcttctccgtgagcctgggcgaccgcgtcaccatcacgtgcaaggcctccgaggacatctacaaccggctcgcctggtaccagcagaagccggggaacgcgccccgcctgctgatcagcgacaccaccaacctctggatcggcgtgccctcccggttcagcgggtccggcagcgggaaggactacaccctgtccatcacgagcctgcagtccgaggacgtggccacctactactgccagcagtactggagctcccgcaccttcggcggcgggaccaagctcgagatcaagcgg

SEQ ID NO: 12326 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcttctccgtgagcctgggcgaccgcgtcaccatcacgtgcaaggcctccgaggacatctacaaccgggtggcctggtaccagcagaagccggggaacgcgccccgcctcctgatgagcgacgccacctccctgggcgccggggtgcccagccggttctccggcagcgggtccggcaaggaccacaccctcagcatcacctccctgcagacggaggacgtcgccacctactactgccagcagtactggaacacccgcaccttcggcgggggcacgaagctggagatcaagcgg

SEQ ID NO: 12327 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagagcatctccacctacctcaactggtaccagcagaagcccgggatcccgcccaagctgctgatcaacgtggcgagctccctccagagcggcgtgccctcccgcttcagcgggtccggcagcgggaccgacttcaccctgacgatctccagcctgcagcccgaggacttcgcctcctactactgccagcagacctacagctccccgcccaccttcggccagggcaccaaggtcgagatcaag

SEQ ID NO: 12328 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccaccctgagcggctccgtgggggaccgcgtcacgatcacgtgccgggccagccagaacatcggcccgtggctcgcctggtaccagcaggagtccgggaaggcgcccaagctgctgatcagccgcgcctccatcctcgagagcggcgtgccctcccggttcagcgggaccggcaccggcaccgagttcaccctgaccatctccagcctgcagcccgacgacttcgccacctactactgccagcactacaacgcctactgggggacgttcggccaggggaccaaggtggagatcaac

SEQ ID NO: 12329 - RNA, 321 nt, synthetic construct
  misc_feature 1..321: note = derived and/or modified sequence opt1 from anti-influenza_Chain
  source 1..321: mol_type = other RNA
gtgatctggatgacccagagcccctccctgctcagcgcctccaccggcgaccgcgtcacgatcagctgccggatgtcccaggggatcagctcctacctggcctggtaccagcagaagccgggcaaggcgcccgagctgctcatccacaccgcctacaccctcaagagcggggtgccctcccgcttcagcggctccgggagcggcaaggacttcaccctgacgatctccggcctgcagagcgaggacttcgccacctactactgccagcagtactactccttcccctacaccttcgggcagggcaccaaggtggagatcaag

SEQ ID NO: 12330 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacgtgagcacctggctggcgtggtaccagctcaagccggggaaggcccccaagctgctgatctacgccgcctccagcctccagtccggcgtccccagccgcttctccgggagcggctccgggaccgacttcaccctgacggtgagctccctgcagcccgaggacttcgccacctactactgccagcaggcgaacagcttcccgttcaccttcggccccggcaccaaggtggacatcaag

SEQ ID NO: 12331 - RNA, 321 nt, synthetic construct
  misc_feature 1..321: note = derived and/or modified sequence opt1 from anti-influenza_Chain
  source 1..321: mol_type = other RNA
gacatccagctgacccagagcccctccttcctcagcgcctccgtgggcgacggggtcaccatcacgtgccgcgccagccaggacatctacatctacctggcgtggtaccagcagaagccgggcaaggcccccaagctgctcatctacgccgcctccaccctgcagggcggggtgcccagccggttctccgggagcggctccggcaccgagttcaccctgacgatcaacaacctccagcccgaggacttcgccacctacttctgccagcagctgaacgggtacccgctgaccttcggcgggggcaccaaggtggagatcaag

SEQ ID NO: 12332 - RNA, 321 nt, synthetic construct
  misc_feature 1..321: note = derived and/or modified sequence opt1 from anti-influenza_Chain
  source 1..321: mol_type = other RNA
gacatccagctgacccagagcccctccagcctctccgccagcgtgggcgaccgcgtcaccctgacgtgccaggcctcccaggacatccggaagttcctgaactggtaccagcagaagccggggaagggccccaagctcctgatctacgacgcgagcaacctgcagcgcggggtgccctcccggttcagcggcgggggctccggcaccgacttcaccctcatcatcagctccctgcagcccgaggacgtggggacctactactgccagcagtacgacggcctgccgttcacgttcgggggcgggaccaagctcgagatcaag

SEQ ID NO: 12333 - RNA, 321 nt, synthetic construct
  misc_feature 1..321: note = derived and/or modified sequence opt1 from anti-influenza_Chain
  source 1..321: mol_type = other RNA
gacatccagctgacccagagcccctccagcctctccgccagcatcggcgaccgcgtgaccatcacgtgccaggcctcccaggacatccggaacagcctgaactggtacgagcacaagccggggaaggcgcccaagctgctcatccacgacgcctccaacctggagaccggcgtccccagccgcttctccgggggcgggagcggcaccgacttcaccctgacgatctccagcctccagcccgaggacttcgccacctactactgccagcaggccaactccttcccgctgaccttcggcgggggcaccaaggtggagatcaag

SEQ ID NO: 12334 - RNA, 321 nt, synthetic construct
  misc_feature 1..321: note = derived and/or modified sequence opt1 from anti-influenza_Chain
  source 1..321: mol_type = other RNA
gacatccagctgacccagagcccctccagcctctccgccagcgtgggcgaccgcgtcaccatcacgtgccgggcctcccaggggatccgcaacgacctgggctggtaccagcagaagccggggaacgcgcccaagcggctgatcttcggcgccagctccctccagagcggggtgccctcccgcttcagcggctccggcagcgggaccgagttcaccctgaccatctccagcctgcagcccgaggacttcgccacgtactactgcctccagcacaactcctacccgtacaccttcggccaggggaccaagctggagatcaag

SEQ ID NO: 12335 - RNA, 321 nt, synthetic construct
  misc_feature 1..321: note = derived and/or modified sequence opt1 from anti-influenza_Chain
  source 1..321: mol_type = other RNA
gacatccagctgacccagagcccctccagcctctccgccagcgtgggcgaccgcgtcaccatcacgtgccgggcctcccagagcatctcccgctacctgaactggtaccagcagaagccggggaaggcgcccaagctgctcctgttcgccgccagcaccctgctcgacggcgtgccctcccggttcagcgggtccggcagcgggaccgacttcaccctgacgatctccagcctgcagcccgaggacttcgccacctactactgccagcgcaaccactccccgagctggaccttcggccagggcacccgggtggagatcaag

SEQ ID NO: 12336 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatgacgtgccgggcctcccagaacatccgcagctacctcaactggtaccagcagcggccggggaccgcgcccaagctgctgatctacgccgcctccaccctccacagcggcgtgccctcccgcttcagcgggggcgggtccggcaccgacttcacgctgaccatcaacaacctgcagcccgaggacttcgccagctactactgccagcagtcctacgacaacccgcagaccttcggccaggggaccaaggtggagatcaag

SEQ ID NO: 12337 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggccaaccaggacatcgggatctacctcaactggtaccagcagaacccgggcaaggtgcccaagctgctgctccacggggcgtccagcctgcagggcggggtgccctcccgcttcagcgcctccggcagcggcaccgacttcaccctgaccatccactccctccagcccgaggacctggccacgtactactgccagcagagccggcgcctgccgtacaccttcgggcagggcacccgggtcgagctcaag

SEQ ID NO: 12338 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccaccctgagcgcctccatcggcgaccgcgtgacgatcacgtgccgggccagccagtccatcgcgagctggctcgcctggtaccagcagaagccggggaaggcccccaagctgctgatctacgaggccgtcaacctcgagtccggcgtgcccagccgcttctccgggagcggctccgggaccgacttcaccctgaccatcagctccctgcagcccgacgacttcgccacctacttctgccagcactacggcaccatcagccagaccttcggcgggggcacgaaggtggagatcaag

SEQ ID NO: 12339 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagagcatctccagctacctcaactggtaccagcacaagccggggaaggcgcccaaggtgctgatgtacgccgtgtccatcctgcagagcggcgtcccctcccgcttcagcgggtccggcagcggggccgacttcaccctcaccatctccagcctgcagcccgaggacttcgccacctactactgccagcagtcctacagctccccgctgacgttcggcggcgggaccaaggtggagatcaag

SEQ ID NO: 12340 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagaacatcaagcgctacttcaactggtaccagcagaagccggggaaggcgcccaagctcctgatctacgccgccagcaacctggagaacggcgtgccctcccggttcagcgggtccggcagcgggaccgacttcaccctcaccatctccagcctgcagcccgaggacttcgccacgtactactgccagcagtccttcagcaagtcctggaccttcggccagggcaccaacgtggacatcaag

SEQ ID NO: 12341 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagaacatctacaagtacctcaactggtaccagcagcgcccggggaaggcgcccaagggcctgatcagcgccgcctccgggctgcagagcggcgtgccctcccggttcagcgggtccggcagcggcaccgacttcaccctcaccatcacgtccctgcagcccgaggacttcgccacctactactgccagcagagctactccccgcccctgaccttcgggggcgggacccgcgtggagatcaag

SEQ ID NO: 12342 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccagctccgtgggcgaccgcgtcaccatcacgtgccgggccagccagtccatcggggcctacgtgaactggtaccagcagaaggcgggcaaggccccgcaggtcctcatcttcggggccagcaacctgcagtccggcgtgcccagccgcttctccgggagcggctccggcaccgacttcaccctgaccatcagctccctccagcccgaggacttcgccacgtacttctgccagcagacctacagcacccccatcaccttcgggcagggcacgcggctggagatcaag

SEQ ID NO: 12343 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatctcctgccgggccagccagtccatcagcacgtacctcaactggtaccagcagcagccggggaaggcgcccaaggtgctgatcttcggcgccaccaacctgcagtccggggtgcccagccgcttctccggcagcgggtccggcaccgacttcaccctcacgatcagctccctgcagcccgaggacttcgccacctactactgccagcagagctacaacaccccgctgatcttcggccaggggaccaagctcgagatcaag

SEQ ID NO: 12344 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatctcctgccgggccagccagtccatcagcacgtacctcaactggtaccagcagcagccggggaaggcgcccaaggtgctgatctccggcgccaccaacctgcagagcggggtgccctcccgcttcagcggctccgggagcggcaccgacttcaccctcacgatctccagcctgcagcccgaggacttcgccacctactactgccagcagtcctacaacaccccgctgatcttcggccaggggaccaagctcgagatcaag

SEQ ID NO: 12345 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcctcaccatcacgtgccgggcctcccagagcatctccacctacctgcactggtaccagcagaagccggggaaggcgcccaagctgctcatctacgccgccagctccctgcagagcggcgtcccctcccgcttcagcgggtcccggagcggcaccgacttcaccctgacgatctccagcctccagcccgacgacttcgccacctactactgccagcagtcctacagcccgcccctgaccttcgggcccggcaccaaggtggacatgaag

SEQ ID NO: 12346 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagagcatctccaactacctcaactggtaccagcacaagccgggggaggcgcccaagctgctgaactacgccgccagctccctccagagcggcgtgccctcccgcttcagcgcctccgggagcggcaccgacttcaccctgaccatctccagcctgcagcccgaggacttcgccacgtactactgccagcagtcctacaacaccccgatcaccttcgggcagggcacccggctcgagatcaag

SEQ ID NO: 12347 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagagcatctccaactacctcaactggtaccagcacaagccgggggaggcgcccaagctgctgaactacgccgccagctccctccagagcggcgtgccctcccgcttcagcgcctccgggagcggcaccgacttcaccctgtccatcagcgggctgcagcccgaggacttcgccacctactactgccagcagtcctacaacacgccgatcaccttcggccccggcacccggctcgagatcaag

SEQ ID NO: 12348 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagagcatctccacctacctcaactggtaccagcagaagccggggaaggcgcccaagctgctgatctacgccgccagctccctccacagcggcgtgccctcccgcttcagcgggtccggcagcgggaccgacttcgccctgaccatctccagcctgcagcccgaggacttcgccacgtactactgccagcagtcctacagcccgcccatcaccttcggccagggcacccggctcgagatcaag

SEQ ID NO: 12349 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatcacgtgccgggcctcccagaccatcagcacctacctcaactggtaccagcagaagtccgggaaggcgccgaagctgctgatctacgccgccagcggcctccagtccggggtgcccagccgcttctccggcagcgggtccggcaccgacttcacgctgaccatcagctccctgcagcccgaggacttcgccacctacttctgccagcagagctacaacacgcccctcaccttcggccaggggaccaaggtggagatcaag

SEQ ID NO: 12350 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcctgtccgccagcgtgggcgaccgcgtcaccatctcctgccgggccagccagtccatcagcacgtacctcaactggtaccagcagcagccggggaaggcgcccaaggtgctgatctccggcgccaccgacctgcagagcggggtgccctcccgcttcagcggctccgggagcggcaccgacttcaccctcacgatctccagcctgcagcccgaggacttcgccacctactactgccagcagtcctacaacaccccgctgatcttcggccaggggaccaagctcgagatcaag

SEQ ID NO: 12351 - RNA, 321 nt, synthetic construct
  misc_feature 1..321: note = derived and/or modified sequence opt1 from anti-influenza_Chain
  source 1..321: mol_type = other RNA
gacatccaggtgacccagagcccctccagcctgtccgccagcgtcggcgaccgcgtgaccatcacgtgccgggcctcccagaacatctacaagtacctcaactggtaccagcagcgcccggggaaggcgcccaagggcctgatcagcgccgcctccgggctgcagagcggcgtgccctcccggttcagcgggtccggcagcggcaccgacttcaccctcaccatcacgtccctgcagcccgaggacttcgccacctactactgccagcagagctactccccgcccctgaccttcgggggcgggacccgcgtcgacatcaag

SEQ ID NO: 12352 - RNA, 321 nt, synthetic construct
  misc_feature 1..321: note = derived and/or modified sequence opt1 from anti-influenza_Chain
  source 1..321: mol_type = other RNA
cagagcgtgctgacccagcccccgtccgagagcgtctcccccggccagaccgccagcgtgacgtgctccgggcacaagctcggcgacaagtacgtgagctggtaccagcagaagcccgggcagtcccccgtcctgctgatctaccaggacaaccgccggccgagcggcatccccgagcgcttcatcgggtccaacagcggcaacaccgccaccctcaccatctccggcacgcaggcgctggacgaggccgactactactgccaggcctgggacagctccaccgccgtgttcgggggcgggaccaagctgaccgtgctcggc

SEQ ID NO: 12353 - RNA, 321 nt, synthetic construct
  misc_feature 1..321: note = derived and/or modified sequence opt1 from anti-influenza_Chain
  source 1..321: mol_type = other RNA
gacatccagctgacccagagcccctccagcctctccgccagcgtgggcgaccgcgtcaccatcacgtgccgggcctcccaggggatcagcacctacctggcgtggtaccagcagaagccgggcaaggtgcccaagctgctcatctacgccgcctccaccctgcagagcggggtgccctcccgcttcagcggctccgggagcggcaccgacttcacgctgaccatctccagcctccagcccgaggacgtcgccacctactactgccagaagtacaactccgccccgagcttcggccccgggaccaaggtggacatcaagcgg

SEQ ID NO: 12354 - RNA, 321 nt, synthetic construct
  misc_feature 1..321: note = derived and/or modified sequence opt1 from anti-influenza_Chain
  source 1..321: mol_type = other RNA
agcgtgctgacccagcccccgtccgccagcggctcccgcgggcagagcatcaccatctcctgcacgggcagcacctccgacatcgggagctacaactacgtctcctggtaccagcagcaccccggcaccgcccccaaggtgatcctctacgaggtgagccagcggccctccggggtcccggaccgcttcagcggctccaagagcggcaacaccgcgttcctgacggtgtccgggctgcaggccgaggacgaggccgactactactgcgccagctacgccggcaacaacatctacgtgttcgggtccggcaccaaggtcacc

SEQ ID NO: 12355 - RNA, 321 nt, synthetic construct
  misc_feature 1..321: note = derived and/or modified sequence opt1 from anti-influenza_Chain
  source 1..321: mol_type = other RNA
agcgccctgacccagcccccgtccgccagcggctcccgcgggcagagcatcaccatctcctgcacgggcagcacctccgacatcgggagctacaactacgtgtcctggtaccagcagcaccccggcaccgcgcccaaggtcatcctctacgaggtgagccagcggccctccggggtgccggaccgcttcagcggctccaagagcggcaacaccgccttcctgacggtctccgggctgcaggccgaggacgaggccgactactactgcgccagctacgcgggcaacaacatctacgtgttcgggtccggcaccaaggtgacc

SEQ ID NO: 12356 - RNA, 321 nt, synthetic construct
  misc_feature 1..321: note = derived and/or modified sequence opt1 from anti-influenza_Chain
  source 1..321: mol_type = other RNA
gagatcgtgctgacccagagccccgccaccctctccctgagccccggcgagcgcgccacgctgtcctgccgggcgagccagtccgtcagcaccttcctcgcctggtaccagcagaagcccgggcaggcgccccgcctgctgatgtacgacgcctccaaccgggccaccggcatccccgcccgcttcagcgggtccggcagcgggaccgacttcacgctcaccatctccagcctggagccggaggacttcgccatctactactgccagcagcggtcccactggccgcccatcttcggccagggcacccgcctggagatcaag

SEQ ID NO: 12357 - RNA, 321 nt, synthetic construct
  misc_feature 1..321: note = derived and/or modified sequence opt1 from anti-influenza_Chain
  source 1..321: mol_type = other RNA
gacatccagatgacccagagccccgcctccctgagcgtgtccgtcggcgagaccgtgaccatcacgtgccgcgccagcgagaagatctactccaacctcgcgtggtaccagcagaaggagggcaagagcccgcagctgctggtgtacgccgccatccggctcgccgacggggtcccctcccgcttcagcgggtccggcagcgggacccagttctccctgaagatcaacagcctgcagtccgaggacttcggcacctactactgccagcacttctggggcacgcccctcaccttcggggccggcaccaagctggagctgaag

SEQ ID NO: 12358 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaaggcccccaagctcctgatctacgccgcctccagcctgcagtccggcgtgcccagccgcttctccgggagcggctccgggaccgacttcaccctcacgatcagctccctgcagcccgaggacttcgccacctacttctgccagcaggcgaacagcttcccgcccaccttcggccagggcaccaagctggagatcaag

SEQ ID NO: 12359 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaaggcccccaagctcctgatctacgccgcctccagcctgcagtccggcgtgcccagccgcttctccgggagcggctccgggaccgacttcaccctcacgatcagctccctgcagcccgaggacttcgccacctacttctgccagcaggcgaacagcttcccgcccaccttcggctgcggcaccaagctggagatcaag

SEQ ID NO: 12360 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaagtgccccaagctcctgatctacgccgcctccagcctgcagtccggcgtgcccagccgcttctccgggagcggctccgggaccgacttcaccctcacgatcagctccctgcagcccgaggacttcgccacctacttctgccagcaggccaacagcttcccgcccaccttcggccagggcaccaagctggagatcaag

SEQ ID NO: 12361 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaaggcccccaagctcctgatctacgccgcctccagcctgcagtccggcgtgcccagccgcttctccgggagcggctccgggaccgacttcaccctcacgatcagctccctgcagcccgaggacttcgccacctactactgccagcaggcgaacagcttcccgcccaccttcggccagggcaccaagctggagatcaag

SEQ ID NO: 12362 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaaggcccccaagctcctgatctacgccgcctccagcctgcagtccggcgtgcccagccgcttctccgggagcggctccgggaccgacttcaccctcacgatcagctccctgcagcccgaggacttcgccacctactactgccagcaggcgaacagcttcccgcccaccttcggctgcggcaccaagctggagatcaag

SEQ ID NO: 12363 - RNA, 321 nt, synthetic construct
  misc_feature 1..321: note = derived and/or modified sequence opt1 from anti-influenza_Chain
  source 1..321: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaagtgccccaagctcctgatctacgccgcctccagcctgcagtccggcgtgcccagccgcttctccgggagcggctccgggaccgacttcaccctcacgatcagctccctgcagcccgaggacttcgccacctactactgccagcaggccaacagcttcccgcccaccttcggccagggcaccaagctggagatcaag

SEQ ID NO: 12364 - RNA, 321 nt, synthetic construct
  misc_feature 1..321: note = derived and/or modified sequence opt1 from anti-influenza_Chain
  source 1..321: mol_type = other RNA
gagatcgtgctgacccagagccccgccaccctctccctgagccccggcgagcgcgccacgctgtcctgccgggcgagccgctccatcaccaccttcctcgcctggtaccagcagaagcccgggcaggcgccccggctgctgatctacgacgccagcaaccgcgccaccggcgtccccgcccggttctccgggagcggctccgggacggacttcaccctcaccatcaacagcctggagccggacgacttcgccatctactactgccagcagcgcgaccactggccgcccatcttcggccagggcacccggctggagatcaag

SEQ ID NO: 12365 - RNA, 321 nt, synthetic construct
  misc_feature 1..321: note = derived and/or modified sequence opt1 from anti-influenza_Chain
  source 1..321: mol_type = other RNA
gagatcgtgctgacccagagccccgccaccctctccctgagccccggcgagcgcgccacgctgtcctgccgggcgagccgctccatcaccaccttcctcgcctggtaccagcagaagcccgggcaggcgccccggctgctgatctacgacgccagcaaccgcgccaccggcgtccccgcccggttctccgggagcggctccgggacggacttcaccctcaccatcaacagcctggagccggacgacttcgccatctactactgccagcagcgcgaccactggccgcccatcttcggctgcggcacccggctggagatcaag

SEQ ID NO: 12366 - RNA, 324 nt, synthetic construct
  misc_feature 1..324: note = derived and/or modified sequence opt1 from anti-influenza_Chain
  source 1..324: mol_type = other RNA
gagatcgtgctgacccagagccccggcaccctctccctgagcccgggggagcgcgccacgctgtcctgccgggccagccagaccgtctccagctcctacctcgcctggtaccagcagaagcccggccaggcgccccgcctgctgatctacggggccagctcccgggccaccggcatccccgaccgcttcagcgggtccggcagcggcaccgacttcacgctcaccatctcccggctggagccggaggacttcgccgtgtactactgccagcagtacgggaacagcccctacaccttcggccaggggaccaagctggagatcaag

SEQ ID NO: 12367 - RNA, 324 nt, synthetic construct
  misc_feature 1..324: note = derived and/or modified sequence opt1 from anti-influenza_Chain
  source 1..324: mol_type = other RNA
gagatcgtgctgacccagagccccggcaccctctccgtcagcccgggggagcgcgccacgctgtcctgccgggccagccagtccatcagctccggctacctggcctggtaccagcagaagcccgggcaggcgccccgcctcctgatctacggcgccagctcccgggccaccgggatccccgaccgcttcagcggctccggcagcgggaccgacttcaccctgacgatctcccggctcgagccggaggacttcgccgtgtactactgccagcagtacggcaccagcccccagaccttcgggcagggcaccaaggtggagatcaag

SEQ ID NO: 12368 - RNA, 324 nt, synthetic construct
  misc_feature 1..324: note = derived and/or modified sequence opt1 from anti-influenza_Chain
  source 1..324: mol_type = other RNA
gaggtggtcctgacccagagccccggcaccctctccctgagcccggggcagcgcgccacgctgtcctgccgggccagccagtccgtgagctccagctacctcgcctggtaccagcagaagcccggccaggcgccccgcctgctgatctacgacgcctccaaccgggccaccgggatccccgaccgcttcagcggctccgggagcggcaccgacttcaccctcacgatctcccggctggagccggaggacttcgccgtgtactactgccagcagtacggcagctccccctacaccttcgggcagggcaccaagctggagatcaag

SEQ ID NO: 12369 - RNA, 324 nt, synthetic construct
  misc_feature 1..324: note = derived and/or modified sequence opt1 from anti-influenza_Chain
  source 1..324: mol_type = other RNA
gacatccagctgacccagagcccctccagcctctccgccagcgtgggcgaccgcgtcaccatcacgtgccgggcctcccaggggatcatcacctacctgaactggtaccagcagaagccgggcaaggcgcccaagctgctcatctacgccacctacagcctgcagaacggggtgccctcccgcttcagcggctccgggagcggcaccgacttcacgctgaccatctccagcctccagcccgaggacttcgccacctactactgccagcagtcctacagctccctgatgttcaccttcggccaggggacgaagctggacatcaag

SEQ ID NO: 12370 - RNA, 324 nt, synthetic construct
  misc_feature 1..324: note = derived and/or modified sequence opt1 from anti-influenza_Chain
  source 1..324: mol_type = other RNA
gagaccgtgctgacccagagccccggcacgctctccctgaccccgggggagcgcgccaccctgagctgccgggtcggccagtccgtgagcgggtcccacctcgcctggtaccagcagaagcccggccaggcgccccgcctgctgatctacggggccagctcccgggccaccggcatccccgaccgcttcggcgggagcgtgtccggcacggacttcaccctcaccatcagccggctggagccggaggactccgccgtctactactgccagcagtacggggacagccgctacaccttcggccaggggacgaagctggagatcaag

SEQ ID NO: 12371 - RNA, 324 nt, synthetic construct
  misc_feature 1..324: note = derived and/or modified sequence opt1 from anti-influenza_Chain
  source 1..324: mol_type = other RNA
gagatcgtgctgacccagagccccggcaccctctccctgagccccggggagcgcgccacgctgtcctgccgggccagccagtccgtcagctccagccagctcgcctggtaccagcagaagcccggccaggcgccccgcctgatcatctacggggcctccacccgggccaccggcatccccgaccgcttcagcgggtccggcagcggcaccgacttcacgctgaccatcgggcggctcgagccggaggacttcgccgtgttcttctgccagcagtactccaccagcccgcccaccttcggccaggggacgaaggtggacttcaag

SEQ ID NO: 12372 - RNA, 324 nt, synthetic construct
  misc_feature 1..324: note = derived and/or modified sequence opt1 from anti-influenza_Chain
  source 1..324: mol_type = other RNA
gacatcgtgctgacccagagccccggcaccctctccctgagcccgggggagcgcgccacgctgtcctgccgggccagccagtccgtcagctccagctacctcgcgtggtaccagcagaagcccggccaggcgccccgcctggtgatgtacggggccgccacccgggccaccggcatccccgaccgcttctccgggagcggctccggcccggacttcaccctgacgatcagccggctcgagcccgaggacttcgccatgtactactgccagcagtacgggaactcccccatcaccttcggccaggggacccgcctggagatcaag

SEQ ID NO: 12373 - RNA, 324 nt, synthetic construct
  misc_feature 1..324: note = derived and/or modified sequence opt1 from anti-influenza_Chain
  source 1..324: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagccactggccgcccatcaccttcggccagggcacccgcctggagatcaag

SEQ ID NO: 12374 - RNA, 324 nt, synthetic construct
  misc_feature 1..324: note = derived and/or modified sequence opt1 from anti-influenza_Chain
  source 1..324: mol_type = other RNA
agctacgagctgacccagcccccgtccgtgagcgtctcccccggccagaccgcccgcatcacgtgcagcggggacgccctccccaagcagaacgcgtactggtaccagcagaagcccggccaggccccggtgctgctgatctacaaggactccgagcggcccagcgggatccccgagcgcttctccggcagctccagcgggaccaccgtgaccctcacgatctccggcgtccaggccgaggacgaggccgactactactgccagagcgccgactccagcggcacctcctgggtgttcgggggcgggaccaagctgaccgtgctg

SEQ ID NO: 12375 - RNA, 324 nt, synthetic construct
  misc_feature 1..324: note = derived and/or modified sequence opt1 from anti-influenza_Chain
  source 1..324: mol_type = other RNA
agctacgtgctgacccaggccccctccgtcagcgtggccccgggccagaccgcgcgcatcacgtgcgggggcaacgccatcgggtccaagaaggtgcactggtaccagcacaaggccggccaggcccccgtcctcgtggtgtacgacgacaccgaccggcccagcgggatccccgagcgcttctccggcagcaactcctggagcaccgccaccctgacgatcaaccgggtcgaggcgggcgacgaggccgactactactgccaggtgtgggacttcaccatcgaccacgtggtcttcgggggcgggaccaagctgaccgtgctc

SEQ ID NO: 12376 - RNA, 324 nt, synthetic construct
  misc_feature 1..324: note = derived and/or modified sequence opt1 from anti-influenza_Chain
  source 1..324: mol_type = other RNA
gagatcgtgctgacccagagccccggcaccctctccctgagcccgggggagcgcgccacgctgtcctgccgggccagccagtccgtcagctccagctacctcgcctggtaccagaagaagcccggccaggcgccccgcctgctgatctacggggcctccacccgggccaccggcatccccgaccgcttcaccgggagcggctccggcacggacttcaccctcagcatctcccggctggagccggaggacttcgccgtgtactactgccagcacttcgggaccagcgtgttcaccttcggcgggggcacgaaggtcgagatcaag

SEQ ID NO: 12377 - RNA, 324 nt, synthetic construct
  misc_feature 1..324: note = derived and/or modified sequence opt1 from anti-influenza_Chain
  source 1..324: mol_type = other RNA
gagatcgtgatgacccagagccccgccaccctgtccgtcagcccgggcgagcgcgccacgctctcctgccgggcgagccagtccgtggggaacagcctggcctggtaccagcagcgccccggccaggcgccccggctgctcatctacggggcctccacccgcgccaccggcatcccgccccggttcagcgggtccggcagcggcaccgagttcacgctgaccatctccagcctgcagaccgaggacttcgccgtgtactactgccagcagtacatcaactggcgccccctctccttcgggggcgggaccaaggtcgagatcaag

SEQ ID NO: 12378 - RNA, 324 nt, synthetic construct
  misc_feature 1..324: note = derived and/or modified sequence opt1 from anti-influenza_Chain
  source 1..324: mol_type = other RNA
caggagagcggcgccgagctggtgcggcccggggcctccgtcaagctcagctgcaaggactccggctacaccttcaccacgtactggatgaactgggtgaagcagcggccggagcaggggctggagtggatcggccgcatcgacccctacgacagcgagacccactacaaccagaagttcaaggacaaggcgatcctgaccgtggacaagtccagcaacaccgcctacatgcagctctccagcctgacgtccgaggacagcgccgtctactactgcgtgcgcgggggctccaccgtggcctacttcggcgtctgggggcagggc

SEQ ID NO: 12379 - RNA, 324 nt, synthetic construct
  misc_feature 1..324: note = derived and/or modified sequence opt1 from anti-influenza_Chain
  source 1..324: mol_type = other RNA
gagatcgtgctgacccagagccccggcaccctctccctgagcccgggggagcgcgccaccctgtcctgccgggccagccagcgcgtctccagctacctcgcgtggtaccagcagaagcccggccaggcgccccggctgctgatctacggggcctccacccgcgccgccggcatccccgaccggttcagcgggtccggcagcggcaccgacttcaccctcacgatctcccgcctggagccggaggacagcgccgtgtactactgccagcagtacgggcggacgcccctgaccttcggcgggggcaccaaggtggagatcaagcgc

SEQ ID NO: 12380 - RNA, 324 nt, synthetic construct
  misc_feature 1..324: note = derived and/or modified sequence opt1 from anti-influenza_Chain
  source 1..324: mol_type = other RNA
gagatcgtgatgacccagagccccggcaccctgtccctcagcccgggggagcgcgccacgctgtcctgccgggccagccagtccgtcagctccagctacctggcctggtaccagcagaagcccggccaggcgccccgcctcctgatcttcggggcctccagccgggccaccggcatccccgaccgcttctccgggagcggctccggcaccgacttcaccctgacgatcagccggctcgagccggaggacttcgccgtgtactactgccagcagtacgggtccagcctgaccttcggcgggggcaccaagctggagatcaagcgc

SEQ ID NO: 12381 - RNA, 324 nt, synthetic construct
  misc_feature 1..324: note = derived and/or modified sequence opt1 from anti-influenza_Chain
  source 1..324: mol_type = other RNA
gagatcgtgctgtaccagagccccggcaccctctccctgagcccgggggagcgcgccaccctgtcctgccgggccagccagcgcgtctccagctacctcgcgtggtaccagcagaagcccggccaggcgccccggctgctgatctacggggcctccacgcgcgccgccggcatccccgaccggttcagcgggtccggcagcggcaccgacttcaccctcaccatctcccgcctggagccggaggacagcgccgtgtactactgccagcagtacgggcggacgcccctgaccttcggcgggggcaccaaggtggagatcaagcgc

SEQ ID NO: 12382 - RNA, 324 nt, synthetic construct
  misc_feature 1..324: note = derived and/or modified sequence opt1 from anti-influenza_Chain
  source 1..324: mol_type = other RNA
gacatcgtgctgacccaggcccccagcgtctccgtgagcccgggccagaccgcctccatcacgtgcagcggggaccgcctcggcgagaagttcgcgtcctggtaccagcagaagcccgggcagagccccgtgctggtcatctacgaggactccaagcggcccagcggcatcccggaccgcttctccgggagcaactccggcaacaccgccaccctgaccatcagcggcacgcagatcatggacgagggggacttcttctgccaggcctgggactccagcaccgtggtgttcggcgggggcaccaagctcaccgtcctggggcag

SEQ ID NO: 12383 - RNA, 324 nt, synthetic construct
  misc_feature 1..324: note = derived and/or modified sequence opt1 from anti-influenza_Chain
  source 1..324: mol_type = other RNA
gacatcgagctgacccagagcccctccgtgagcgtctccccgggccagaccgccagcatcacgtgctccggggacaagctcggcgacaagttcgtgtgctggtaccagcagaaggccgggcagagccccatcgtggtcatctaccaggacgacaagcgcccctccggcatccccgagcggttcagcgggtccaacagcggcaacaccgcgaccctgaccatctccggcacgcaggccatggacgaggccgactacttctgccaggcctgggacagcaccaccgtggtgttcgggggcgggaccaagctgacggtcctcggccag

SEQ ID NO: 12384 - RNA, 324 nt, synthetic construct
  misc_feature 1..324: note = derived and/or modified sequence opt1 from anti-influenza_Chain
  source 1..324: mol_type = other RNA
cagagcgtgctgacccagcccccgtccgccagcggctcccgcgggcagagcatcaccatctcctgcacgggcagcacctccgacatcgggagctacaactacgtctcctggtaccagcagcaccccggcaccgcccccaaggtgatcctctacgaggtgagccagcggccctccggggtcccggaccgcttcagcggctccaagagcggcaacaccgcgttcctgacggtgtccgggctgcagaccgacgacgaggccgactactactgcgccagctacgccggcaacaacatctacgtgttcgggtccggcaccaaggtcacc

SEQ ID NO: 12385 - RNA, 327 nt, synthetic construct
  misc_feature 1..327: note = derived and/or modified sequence opt1 from anti-influenza_Chain
  source 1..327: mol_type = other RNA
aacttcatgctgacccagccccacagcgtgtccgagagcccgggcaagaccgtcacgatctcctgcaccgggagcggcgggaacatcgcccgcaactacgtgcagtggtaccagcagcggcccggctccgcccccgtgaccgtcatcctcgaggacgacaagcgccccagcgggatcccggaccggttctccggcagcatcgaccgctccagcaactccgcgagcctgaccatctccggcctgcggacggaggacgaggccctctactactgccagagctacgacgactccgacctggtggtgttcgggggcgggaccaagctgacc

SEQ ID NO: 12386 - RNA, 327 nt, synthetic construct
  misc_feature 1..327: note = derived and/or modified sequence opt1 from anti-influenza_Chain
  source 1..327: mol_type = other RNA
atgctggagcccctccagatcctgagcatctgctccttcatcctgagcgccctccacttcatggcctggaccatcggccacctgaaccagatcaagcgcggggtgaacctgaagatccagatccggaacccgaacaaggaggcgatcaaccgcgaggtctccatcctccggcacaactaccagaaggagatccaggccaaggagaccatgaagaagatcctgagcgacaacatggaggtgctgggcgaccacatcgtggtcgaggggctctccacggacgagatcatcaagatgggcgagaccgtgctggaggtggaggagctgcag

SEQ ID NO: 12387 - RNA, 327 nt, synthetic construct
  misc_feature 1..327: note = derived and/or modified sequence opt1 from anti-influenza_Chain
  source 1..327: mol_type = other RNA
gacatccgcctgacccagagccccgccaccctctccgtgagcccgggcgagcgggccacgctgtcctgccgcgcgagccactccgtcagccggaacctggcctggtaccagcagaagcccgggcgcgcgccccggctcctggtgtacgacacctccagccgcgccaccggcatccccgcccggttctccgggagcggctccgggaccgagttcacgctgaccatcagctccctccagagcgaggacttcgccgtgtactactgccagcagtacaacaactggccgcgcaccttcggccagggcaccaaggtcgacatcaagcggacg

SEQ ID NO: 12388 - RNA, 327 nt, synthetic construct
  misc_feature 1..327: note = derived and/or modified sequence opt1 from anti-influenza_Chain
  source 1..327: mol_type = other RNA
gagatcgtgatgacccagagccccggcaccctgtccctcagcccgggggagcgcgccacgctgtcctgccgggccagccagtccgtcagctccagctacctggcctggtaccagcagaagcccggccaggcgccccgcctcctgatctacggggcctccacccgggccaccggcgtgcccgaccgcttccacgggggcggcagcgggaccgacttcacgctgaccatctcccggctcgagccggaggacttcgccgtgtactactgccagcagtacgacaccagctccggcctgaccttcgggggcgggacgaaggtcgagatcaag

SEQ ID NO: 12389 - RNA, 327 nt, synthetic construct
  misc_feature 1..327: note = derived and/or modified sequence opt1 from anti-influenza_Chain
  source 1..327: mol_type = other RNA
gagatcgtgatgacccagttccccgccaccctgagcgtctcccccggcgagcgcgtgacgctcagctgccgggcctcccagagcgtgtccaacaacctggcgtggtaccagcagaagcccgggcagccgccccgcctgctcatctacgacgccagcacccgggccaccggcgtccccgccaagttctccgggaccggcagcgggacggagttcaccctgtccatcagctccctgcagagcgaggacttcgccgtgtactactgccagcagtaccacaactggccgccctcctacagcttcggcctcggcaccaagctggagatcaag

SEQ ID NO: 12390 - RNA, 327 nt, synthetic construct
  misc_feature 1..327: note = derived and/or modified sequence opt1 from anti-influenza_Chain
  source 1..327: mol_type = other RNA
gagatcatcctggcccagagccccggcaccctctccctgagcccgggggagcgcgccaccctgtcctgccgggcgagccagttcgtgtccacgcgcagcctcgcctggtaccagcagcggcccggccaggcgccccgcctgctgatctacggggcctccagccgggccaccggcatccccgaccgcttctccgggagcggctccggcaccgacttcaccctcacgatcagccggctggagccggaggacttcgccgtctactactgccagcactacgggtacagcccccgctacgccttcggccaggggtccaaggtggagatcaag

SEQ ID NO: 12391 - RNA, 327 nt, synthetic construct
  misc_feature 1..327: note = derived and/or modified sequence opt1 from anti-influenza_Chain
  source 1..327: mol_type = other RNA
gagatcgtgctgacccagtcccccggcaccctctccctgagcccgggggagcgcgccacgctgtcctgccgggccagccacttcgtcaactaccgctccctcgcgtggtaccagcagacccccggccaggtgccccggctgctgatctacggggccagcacccgcgccaccggcatccccgaccggttctccgggagcggctccggcacggacttcaccctcaccatcagccgcctggagccggaggacttcgccgtgtacttctgccagcagtacgggggcagcccccggtacaccttcgggcagggcacgcgcctggagatcaag

SEQ ID NO: 12392 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccggcaccctctccctgagcccgggggagcgcgccacgctgtcctgccgggccagccacttcgtcatcggccgcgcggtggcctggtaccagcagaagcccgggcaggcgccccggctcctgatctacggcgcctccagccgcgccaccgggatccccgaccggttctccggcagcggctccgggaccgacttcaccctgacgatcagccgcctcgagaccgaggacttcgccgtgttctactgccagcactacggctccagcccgcggtacgccttcgggcagggcaccaagctggagatcaag

SEQ ID NO: 12393 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccctgagccccggcgagcgcgccacgctgtcctgccgggcgagccagtccgtcgggaactacctcgcctggtaccagcagaagcccggccaggcgccccgcctgctgatctacgacagctccaaccgggcccccgggatcccggcccgcttcagcggctccgggagcggcaccgacttcaccctcaccatctccagcctggcccccgaggacttcgccgtgtactactgccagcagcggtccaagtggccgcccatgtacagcttcggccacgggacgaagctggagatcaag

SEQ ID NO: 12394 - RNA, 327 nt, synthetic construct
  misc_feature 1..327: note = derived and/or modified sequence opt1 from anti-influenza_Chain
  source 1..327: mol_type = other RNA
caggccgtggtcacccaggagcccagcctgaccgtgtccccgggcgggacggtgaccctgacctgcggcagctccaccgggcccgtcacgagcggccactacccctactggttccagcagaagcccgggcaggccccgcgcaccctcatctccgcgaccagcaacacccactcctggacgcccgcccggttcagcggctccctgctcggcgggcgcgccgccctgaccctgagcggcgcccagcccgaggacgaggcggactactactgcttcctctcctacagcggggcctgggtgttcggcgggggcaccaccctgacggtgctg

SEQ ID NO: 12395 - RNA, 327 nt, synthetic construct
  misc_feature 1..327: note = derived and/or modified sequence opt1 from anti-influenza_Chain
  source 1..327: mol_type = other RNA
gccatccagatgacccagagcccctccagcctgtccgccagcgtgggcgaccgcgtcaccatcacgtgccgggcgtcccagaacatccgcagctacctcaactggtaccagcagaagccggggaaggcccccaacctgctgatctacggcaccacctccctcgagagcggggtgccctcccggttcagcggctccgggagcggcaccgacttcacgctgaccatctccagcctgcagcccgaggacttcgccacctactactgccagcagtcctaccacaccccgcagacgttcggccaggggaccaaggtggagatcaagcgcacc

SEQ ID NO: 12396 - RNA, 327 nt, synthetic construct
  misc_feature 1..327: note = derived and/or modified sequence opt1 from anti-influenza_Chain
  source 1..327: mol_type = other RNA
gacatccagatgacccagagcccctccagcctgtccgccagcgtgggcgaccgcatcaccatcacgtgccgggcctcccaggggatcgacaactacctcgcgtggttccagcagaagccgggcaaggtccccgagctgctgatctacgccgccagcaccctccagtccggggtgcccagccgcttctccggcagcgggtccggcaccggcttcaccctgacgatcagctccctgcagcccgaggacgtggccacctactactgccagaagtacgacagcgccccgctcaccttcgggggcgggaccaaggtcgacatcaagcggacg

SEQ ID NO: 12397 - RNA, 327 nt, synthetic construct
  misc_feature 1..327: note = derived and/or modified sequence opt1 from anti-influenza_Chain
  source 1..327: mol_type = other RNA
gacatccagctgacccagagcccctccagcctctccgccagcgtgggcgaccgcgtcaccatcacgtgccgggcctcccaggggatcaccgactacctggcgtggtaccagcagaagccgggcaccatccccaagctgctcatctacgccgccagcaccctgcagtccggggtgcccagccgcttctccggcgggggctacggcacggacttcaccctgaccatcagctccctccagcccgaggacgtggccacctactactgccagaagtacaacagcgccccgctgacgttcgggggcgggaccaaggtcgagatcaagcggacc

SEQ ID NO: 12398 - RNA, 327 nt, synthetic construct
  misc_feature 1..327: note = derived and/or modified sequence opt1 from anti-influenza_Chain
  source 1..327: mol_type = other RNA
gacatcgtgatgacccagagccccttctccctgagcctctccccgggcgagcgcgccaccctgagctgccgggcctcccagagcatctccaactacctggcctggtaccagcagaagcccgggcaggcgccccgcctcctgatctacgacagctccaaccgggccacgggcgtccccgcccgcttcagcgggtccggcagcgggaccgacttcaccctgaccatctccagcctcgagccggaggacttcgccgtgtactactgccagcagcggtccaactggatgtacacgttcggccagggcaccaaggtggagatcaagcgcacc

SEQ ID NO: 12399 - RNA, 327 nt, synthetic construct
  misc_feature 1..327: note = derived and/or modified sequence opt1 from anti-influenza_Chain
  source 1..327: mol_type = other RNA
gacatccagatgacccagagcccctccagcctgtccgccagcgtgggcgaccgcgtcaccatcacgtgccgggcctcccaggggatcagctcctacctcgcgtggtaccagcagaagccgggcaaggtgcccaccctgctgatctacgacgccagcaccctccgctccggggtgcccagccggttctccggcagcgggtccgccaccgacttcacgctgaccatcagctccctgcagcccgaggacgtcgccacctactactgccagcgctacaacagcgccccgcccatcaccttcggccagggcacgcggctcgagatcaagcgc

SEQ ID NO: 12400 - RNA, 327 nt, synthetic construct
  misc_feature 1..327: note = derived and/or modified sequence opt1 from anti-influenza_Chain
  source 1..327: mol_type = other RNA
gagatcgtgatgacccagagccccggcaccctgtccctcagcccgggggagcgcgccacgctgtcctgccgggccagccagtccgtcagctccagctacctggcctggtaccagcagaagcccggccaggcgccccgcctcctgatctacgacgcctccagccgggccaccgacatccccgaccgcttctccgggagcggctccgggaccgacttcaccctgacgatcagccggctcgagccggaggacttcgccgtgtactactgccagcagtacggctccagcctgtggaccttcggccaggggaccaaggtggagatcaagcgc

SEQ ID NO: 12401 - RNA, 327 nt, synthetic construct
  misc_feature 1..327: note = derived and/or modified sequence opt1 from anti-influenza_Chain
  source 1..327: mol_type = other RNA
agctacgtgctgacccagcccccgtccgtcagcgtggcccccggccagaccgcccgcatcacgtgcgggggcaacaacatcgggtccaagagcgtgcactggtaccagcagaagcccggccaggcgcccgtcctcgtggtgtacgacgactccgaccggccgagcgggatccccgagcgcttctccggcagcaactccggcaacaccgccaccctgaccatcagccgggtcgaggccggggacgaggccgactactactgccaggtgtgggactccagctccgaccacgccgtgttcggcgggggcacgcagctgaccgtcctcggg

SEQ ID NO: 12402 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcccccgcaccttcggcgggggcaccaaggtggagatcaagcgg

SEQ ID NO: 12403 - RNA, 327 nt, synthetic construct
  misc_feature 1..327: note = derived and/or modified sequence opt1 from anti-influenza_Chain
  source 1..327: mol_type = other RNA
agctacgtgctgacccagcccccgtccgtcagcgtggcccccggccagaccgcccgcatcacgtgcgggggcaacaacatcgggtccaagggcgtgcactggtaccagcagaagcccgggcaggcgcccgtcctcgtggtgtacgacgacagcgaccggccgtccggcatccccgagcgcttcagcggctccaacagcgggaacaccgccaccctgaccatctcccgggtcgaggccggcgacgaggccgactactactgccaggtgtgggacagctccagcgaccacgtggtcttcgggggcgggacgaagctgaccgtgctcggc

SEQ ID NO: 12404 - RNA, 327 nt, synthetic construct
  misc_feature 1..327: note = derived and/or modified sequence opt1 from anti-influenza_Chain
  source 1..327: mol_type = other RNA
gagatcgtgctgacccagtcccccggcaccctctccctgagcccgggggagcgcgccacgctgtcctgccgggccagccagtccgtcagctccaactacctcggctggacccagcagaagcccgggcaggcgccccgcctgctgatctacggcgccagctcccgggccagcgggatccccgaccgcttctccggcggcgggagcggcaccgacttcaccctcacgatctcccggctggagccggaggacttcgccgtgtactactgccagcagtacgggagcagccccctgaccttcggcgggggcaccaaggtggagatcaagcgc

SEQ ID NO: 12405 - RNA, 327 nt, synthetic construct
  misc_feature 1..327: note = derived and/or modified sequence opt1 from anti-influenza_Chain
  source 1..327: mol_type = other RNA
cagagcgtggtcacccagcccccgtccgtgagcgtggcccccggccagaccgcccgcatcacgtgcgggggcaacaacatcgggtccaagagcgtccactggtaccagcagaagcccggccaggcgcccgtgctggtggtctacgacgactccgaccggccgagcgggatccccgagcgcttctccggcagcaactccggcaacaccgccaccctcaccatcagccgggtggaggccggggacgaggccgactactactgccaggtgtgggactccagctccgaccactacgtcttcggcacggggaccaaggtgaccgtgctgggc

SEQ ID NO: 12406 - RNA, 327 nt, synthetic construct
  misc_feature 1..327: note = derived and/or modified sequence opt1 from anti-influenza_Chain
  source 1..327: mol_type = other RNA
agctacgtgctgacccagcccccgtccgagagcgtcgcccccggccagaccgcccgcatcacgtgcgggggcaacaacatcgggcggaactccgtgcactggtaccagcagaagcccggccaggcgcccgtgctcgtcgtgtacgacgacagcgaccgcccgtccgggatccccgagcggttcagcggctccaagagcggcaacaccgccaccctgatcatctcccgcgtggaggtcggggacgaggccgactactactgccaggtgtggcacagctccagcgaccactacgtgttcggcaccgggacgaaggtcaccgtgctgggc

SEQ ID NO: 12407 - RNA, 327 nt, synthetic construct
  misc_feature 1..327: note = derived and/or modified sequence opt1 from anti-influenza_Chain
  source 1..327: mol_type = other RNA
gagatcgtgatgacccagagccccggcaccctgtccctcagcccggggcagcgcgccacgctgtcctgccgggccagccagtccgtcagctccagctacctggcctggtaccagcagaagcccggccaggcgccccgcctcctgatgtacggggcctccagccgggccaccggcatccccgaccgcttctccgggagcggctccggcaccgacttcaccctgacgatcagccggctcgagccggaggacttcgccgtgtactactgccagcagtacgggtccagctccctgaccttcggcgggggcaccaagctggagatcaagcgc

SEQ ID NO: 12408 - RNA, 327 nt, synthetic construct
  misc_feature 1..327: note = derived and/or modified sequence opt1 from anti-influenza_Chain
  source 1..327: mol_type = other RNA
caggccggcctgacccagcccccgagcgtgtccgtcgcccccgggcagaccgcgcgcatcacgtgcggcgggaacaacatcggcagcaagtccgtgcactggtaccagcagaagcccgggcaggcccccgtgctcgtcgtgtacgacgacagcgaccggccgtccggcatccccgagcgcttcagcggctccaacagcgggaacaccgccaccctgaccatctcccgggtggaggccggcgacgaggccgactactactgccaggtctgggacagctccagcgaccacgtggtgttcgggggcgggacgaagctgaccgtcctcggc

SEQ ID NO: 12409 - RNA, 327 nt, synthetic construct
  misc_feature 1..327: note = derived and/or modified sequence opt1 from anti-influenza_Chain
  source 1..327: mol_type = other RNA
cagagcgtggtcacccagcccccgtccgagagcgtggcccccggccagaccgcccgcatcacgtgcgggggccacaacatcgggtccaacagcgtgcactggtaccagcagaagcccggccaggcgcccgtcctggtggtgtacgacaactccgaccggccgagcgggatccccgagcgcttctccggcagcaactccggcaacaccgccaccctcaccatcagccgggtcgaggccggggacgaggccgactactactgccaggtgtggggctccagctccgaccactacgtgttcgggacgggcaccaaggtcaccgtgctgggg

SEQ ID NO: 12410 - RNA, 327 nt, synthetic construct
  misc_feature 1..327: note = derived and/or modified sequence opt1 from anti-influenza_Chain
  source 1..327: mol_type = other RNA
gagatcgtgctgacccagtcccccggcaccctctccctgagcccgggggagcgcgccacgctgtcctgccgggccagccagtccgtcagctccaactacctcggctggtaccagcagaagcccgggcaggcgccccgcctgctgatctacggcgccagctcccgggccagcgggatccccgaccgcttctccggcggcgggagcggcaccgacttcaccctcaccatctcccggctggagccggaggacttcgccgtgtactactgccagcagtacgggagcagccccctgacgttcggcgggggcaccaaggtggagatcaagcgc

SEQ ID NO: 12411 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtggacagcaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactggccgccccggctgaccttcggcggcgggtccaaggtggagatcaag

SEQ ID NO: 12412 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtgagccacaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactacccgccccggctgaccttcggcggcgggtccaaggtggagatcaag

SEQ ID NO: 12413 - RNA, 327 nt, synthetic construct
  misc_feature 1..327: note = derived and/or modified sequence opt1 from anti-influenza_Chain
  source 1..327: mol_type = other RNA
gagatcgtgatgacccagagccccgccaccctgtccgtcagcccgggcgagcgcgccacgctctcctgccgggcgagccagtccgtggacagcaacctggcctggtaccagcagaagcccgggcaggcgccccgcctgctcgtgtactccgccagcacccgggccaccggcatccccgcccgcttctccgggagcggctccgggaccgagttcacgctggccatcagctccctgcagagcgaggacttcgccgtctactactgccagcactacaccaactggccgccccggctcaccttcggcggcgggtccaaggtggagatcaag

SEQ ID NO: 12414 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtgagctccaacctggcctggtaccagcagaagcccgggcaggcgccccgcctcctggtgtacagcgcctccacccgggccaccggcatccccgcccgcttcagcgggtccggcagcgggaccgagttcacgctggccatctccagcctccagtccgaggacttcgccgtctactactgccagcactacaccaactggccgccccggctgaccttcggcggcgggagcaaggtggagatcaag

SEQ ID NO: 12415 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtggaccacaacctggcctggtaccagcagaagcccgggcaggcgccccgcctcctggtgtacagcgcctccacccgggccaccggcatccccgcccgcttcagcgggtccggcagcgggaccgagttcacgctggccatctccagcctccagtccgaggacttcgccgtctactactgccagcactacaccaactggccgccccggctgaccttcggcggcgggagcaaggtggagatcaag

SEQ ID NO: 12416 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtgagccacaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactggccgccccggctgaccttcggcggcgggtccaaggtggagatcaag

SEQ ID NO: 12417 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtgagccacaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaacttcccgccccggctgaccttcggcggcgggtccaaggtggagatcaag

SEQ ID NO: 12418 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtggacagcaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaacttcccgccccggctgaccttcggcggcgggtccaaggtggagatcaag

SEQ ID NO: 12419 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccagtccgtggacagcaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactacccgccccggctgaccttcggcggcgggtccaaggtggagatcaag

SEQ ID NO: 12420 - RNA, 327 nt, synthetic construct
  misc_feature 1..327: note = derived and/or modified sequence opt1 from anti-influenza_Chain
  source 1..327: mol_type = other RNA
gagaccaccctgacgcagagccccgccaccctctccgtgagcccgggcgagcgcgccaccctgtcctgccgggcgagccaggtcatctcccacaacctggcctggtaccagcagaagcccgggcaggcgccccgcctcctgatctacggcgccagcacccgggcctccgggatccccgcccgcttcagcggctccgggagcggcacggactacaccctgaccatcacctccctccagagcgaggacttcgccgtgtactactgccagcactactccaactggccgccccggctgacgttcggcgggggcaccaaggtggagatcaag

SEQ ID NO: 12421 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagagcgaggacttcgccgtgtactactgccagcactactccaactggccgccccggctgaccttcggcgggggcaccaaggtcgagatcaag

SEQ ID NO: 12422 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagccccggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagccggaggacttcgccgtgtactactgccagcactacagcaactggccgccccggctgaccttcggcgggggcaccaaggtcgagatcaag

SEQ ID NO: 12423 - RNA, 327 nt, synthetic construct
  misc_feature 1..327: note = derived and/or modified sequence opt1 from anti-influenza_Chain
  source 1..327: mol_type = other RNA
gagatcgtgatgacccagagccccgccaccctgtccgtcagcccgggcgagcgcgccacgctctcctgccgggcgagccaggtgatctcccacaacctggcctggtaccagcagaagcccgggcaggcgccccgcctgctcatctacggcgccagcacccgggcctccgggatccccgcccgcttcagcggctccgggagcggcaccgactacaccctgacgatcacctccctgcagagcgaggacttcgccgtgtactactgccagcactactccaactggccgccccggctcaccttcggcgggggcaccaaggtcgagatcaag

SEQ ID NO: 12424 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagagcgaggacttcgccgtgtactactgccagcactactccaacttcccgccccggctgaccttcggcgggggcaccaaggtcgagatcaag

SEQ ID NO: 12425 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagagcgaggacttcgccgtgtactactgccagcactactccaactacccgccccggctgaccttcggcgggggcaccaaggtcgagatcaag

SEQ ID NO: 12426 - RNA, 327 nt, synthetic construct
  misc_feature 1..327: note = derived and/or modified sequence opt1 from anti-influenza_Chain
  source 1..327: mol_type = other RNA
gagatcgtgctgacccagagccccgccaccctctccgtcagcccgggcgagcgcgtgacgctgtcctgccgggccagccagtccgtggcgaacaacctggcctggtaccagcagaagcccgggcagagcccccgcctcctgatctacggcgcctccacccgggacaccgggatccccgcccgcttcagcggctccgggagcggcaccgagttcacgctgaccatctccagcctccagtccgaggacttcgccgtctactactgccagcagtacaacaactggccgcccatgtacaccttcggccaggggaccaagctggagatcaag

SEQ ID NO: 12427 - RNA, 327 nt, synthetic construct
  misc_feature 1..327: note = derived and/or modified sequence opt1 from anti-influenza_Chain
  source 1..327: mol_type = other RNA
gacatcgtgatgacccagagcccctccaccctgagcgcctccgtcggcgaccgcgtgacgatcacgtgccgggccagccagtccatcgggaactggctcgcgtggtaccagcagaagccgggcaaggcccccaagctgctgatctacaaggtgagcaccctcgagtccggggtccccagccgcttctccggcagcgggtccggcaccgagttcaccctgaccatcaacagcctgcagcccgacgacttcgccacctactactgccagcggtacacctccaacagccagggcttcacgttcgggcagggcaccaagctcgagatcaag

SEQ ID NO: 12428 - RNA, 327 nt, synthetic construct
  misc_feature 1..327: note = derived and/or modified sequence opt1 from anti-influenza_Chain
  source 1..327: mol_type = other RNA
gacatcgtgatgacccagagccccgccaccctgtccgtcagcccgggcgagcgcgccacgctctcctgccgggcgagccaggtggtggggaccaacctggcctggtaccagcagaagcccggccaggcgccccgcctgctcatctacgccgcctccacccgggccaccgggatccccgcccgcttcagcggctccgggttcggcacggacttcaccctgaccatcagctccctgcagagcgaggacttcgccgtctactactgccagcagtacaacaactggccgctctccttcggcgggggcaccaaggtggagatccggcgcacg

SEQ ID NO: 12429 - RNA, 327 nt, synthetic construct
  misc_feature 1..327: note = derived and/or modified sequence opt1 from anti-influenza_Chain
  source 1..327: mol_type = other RNA
gacatccagatgacccagagcccctccagcctgtccgccagcgtgggcgaccgcgtcaccatcgtgtgccgggcctcccaggggatcaacacgcacctccactggtaccagcagaagccgggcaaggcgcccaagctgctgatctacagcgcctccaccctccacaccggggtgcccagccgcctgtccggcagcgggtccggcaccgacttcacgctgagcatctccagcctccagcccgaggacttcgccacctactactgccagcagtcctacaactacccgcggaccttcggccaggggaccaacgtcgacatcaagcgcacg

SEQ ID NO: 12430 - RNA, 327 nt, synthetic construct
  misc_feature 1..327: note = derived and/or modified sequence opt1 from anti-influenza_Chain
  source 1..327: mol_type = other RNA
gacatcctgatgacccagagcccctccagcctctccgccagcgtgggcgaccgcgtcaccatcacgtgccgggcctcccaggacatccgcaaccggctggcgtggtaccagcagaagccggggaaggcccccaagcgcctgatctacgccgccagctccctccagagcggcgtgccctcccggttcagcgggtccggcagcgggaccgagttcaccctgaccatcaactccctgcagcccgaggacttcgccacgtactactgcctccagcacaacagctacccgtggaccttcggccccggcaccaaggtggagatcaagcgcacc

SEQ ID NO: 12431 - RNA, 327 nt, synthetic construct
  misc_feature 1..327: note = derived and/or modified sequence opt1 from anti-influenza_Chain
  source 1..327: mol_type = other RNA
gacatcgtgatgacccagagccccgccaccctgtccgtcagcccgggcgagggggccacgctctcctgccgcgcgagccagggcatcgggtccaacctggcctggtaccagcacaagcccggccaggcgccccggctgctcatctacgccgccagcacccgcgccaccggggtgcccgcccggttctccggcagcggctccgggaccgagttcacgctgaccatcagctccctgcagagcgaggacctcgccgtgtacttctgccagcagtacaacacctggccgctgaccttcggcgggggcacgaaggtcgagatcatccgcacc

SEQ ID NO: 12432 - RNA, 327 nt, synthetic construct
  misc_feature 1..327: note = derived and/or modified sequence opt1 from anti-influenza_Chain
  source 1..327: mol_type = other RNA
gacatcgtgatgacccagagcccctccaccctgagcgcctccgtcggcgaccgcgtgacgatcacgtgccgggccagccagaccatctaccgctggctcgcgtggtaccagcagaagccggggaaggcccccaaggtgctgatctacaaggcctccaccctggagagcggcgtcccctcccggttcagcgggtccggcagcgggaccgagttcaccctcgccatctccagcctgcagcccgacgacttcgccacctactactgccagcagtacaactccttcccgtaccgcttcggccagggcaccaaggtggagatcaagcggacg

SEQ ID NO: 12433 - RNA, 327 nt, synthetic construct
  misc_feature 1..327: note = derived and/or modified sequence opt1 from anti-influenza_Chain
  source 1..327: mol_type = other RNA
gacatcgtgatgacccagagcccctccagcctgtccgccagcgtcggcgaccgcgtgtccatcacgtgccgggccagccagaccatcacccgcttcctcaactggtaccagcagaagccggggaagggccccaagctgctgatctacgcggcctccaccgtgcaccgcggggtccccagccggttctccggcagcgggtccggcaccgacttcacgctcaccatcagctccctgcagcccgaggacttcgccacctactactgccagcagagctactccgccccgttcaccttcggccccgggacgaccgtggacatccggcgcacc

SEQ ID NO: 12434 - RNA, 327 nt, synthetic construct
  misc_feature 1..327: note = derived and/or modified sequence opt1 from anti-influenza_Chain
  source 1..327: mol_type = other RNA
gacatcgtgatgacccagcccccggccaccctgagcgtctcccccggcgagcgcgccacgctcagctgcggggcgtcccagggcctggggagcaacctggcctggtaccagcagaagcccggccaggcgccccggctcctgatctacgccgcctccacccgcgccaccgggatcaccgcccggttcagcggctccggcagcgggacggagttcaccctgaccatcaactccctccagagcgaggacttcgccctgtactactgccagcagtacacctactggccgctgacgttcggcgggggcaccaaggtggagatcaagcgcacc

SEQ ID NO: 12435 - RNA, 327 nt, synthetic construct
  misc_feature 1..327: note = derived and/or modified sequence opt1 from anti-influenza_Chain
  source 1..327: mol_type = other RNA
gacatcgtgctgacccagagccccgccaccctctccgtcagccccggcgagcgcgccacgctgtcctgccgggcgagccagtccgtgaaccgcaacctggcctggttccagcagatccccgggcaggcgccccggctcctgatcttcgacgccagcacccgcgccgccgacatccccgcccggttctccggcgggggcagcggggccgagttcaccctgaccgtgtccagcctccagccggaggacttcgccgtctactactgccagcagtacgacaagtggccgcccggcttcggccaggggacgaaggtggagatcaagcgcacc

SEQ ID NO: 12436 - RNA, 330 nt, synthetic construct
  misc_feature 1..330: note = derived and/or modified sequence opt1 from anti-influenza_Chain
  source 1..330: mol_type = other RNA
cagagcgtgctgacccagcccccgtccgccagcggcgcccccgggcagcgcgtcaccctctcctgcagcggctccgggagcaacatcggctccaacacggtgagctggtaccagcagctgcccgggaccgcgcccaagctgctcgtgttcaccaacaaccagcggccgtccggcgtccccgaccgcttcagcggctccaagagcgggacctccgccagcctggccatctccggcctgcagagcgaggacgaggccgactactactgcgccgcgtgggacgactccctcaacgggcagctgttcggcgggggcacgaagctgaccgtgctc

SEQ ID NO: 12437 - RNA, 330 nt, synthetic construct
  misc_feature 1..330: note = derived and/or modified sequence opt1 from anti-influenza_Chain
  source 1..330: mol_type = other RNA
cagagcgtgctgacccagcccccgtccgtcagcgccgcccccggccagcgcgtgaccatctcctgcagcgggacgtccagcaacatcggcaagaactacgtgtcctggtaccagcagctccccggggcggcccccaagctgctgatctacgacaacgacaagcggccgagcggcatccccgaccgcttctccgggagcaagtccggcaccagcgccaccctcggcatcaccgggctgcagacgggcgacgaggccgactactactgcgggacctgggactccagcctgtccgtcggcatgttcgggggcggcacccggctcaccgtgctg

SEQ ID NO: 12438 - RNA, 330 nt, synthetic construct
  misc_feature 1..330: note = derived and/or modified sequence opt1 from anti-influenza_Chain
  source 1..330: mol_type = other RNA
gagaccaccctgacgcagagccccgccaccctctccgtgagcccgggcgagcgcgccaccctgtcctgccgggcgagccagtccgtcagccgcaacctggcctggtaccagcagaagcccgggcaggcgccccggctcctgatctacggcgcctccagccgcgccaccgggatccccgaccggttctccggcagcgggtccggcacggacttcaccctgaccatcagccgcctcgagccggaggacttcgccgtgtactactgccagcagtacggctccagctccatcaccttcgggcagggcacgcggctggagatcaagcgcaccgtg

SEQ ID NO: 12439 - RNA, 330 nt, synthetic construct
  misc_feature 1..330: note = derived and/or modified sequence opt1 from anti-influenza_Chain
  source 1..330: mol_type = other RNA
cagagcgtgctgacccagcccccgtccgccagcggcacccccgggcagcgcgtcacgatctcctgcagcggctccagctccaacatcgggagcaacaccgtgaactggtacaagcagctccccggcaccgcgccccggctgctgatctactccaacgaccagcgcccgagcggggtgcccgaccggttctccggcagcaagtccggcaccagcgcctccctcgccatcagcgggctgcagtccgaggacgaggccaactactactgcgccgcctgggacgacagcctgtccggctgggtcttcgggggcgggacgaagctcaccgtgctg

SEQ ID NO: 12440 - RNA, 330 nt, synthetic construct
  misc_feature 1..330: note = derived and/or modified sequence opt1 from anti-influenza_Chain
  source 1..330: mol_type = other RNA
cagagcgccctgacccagccccgctccgtgagcggctccccggggcagagcgtcaccatctcctgcacgggcagctccagcgacgtgggggcctccaacagcgtgtcctggtaccagcagcaccccggcaaggcgcccaagctcgtcatctacgacgtgaccgagcggcccagcggggtgccgcaccgcttctccggcagcaagtccggcaacaccgccagcctgaccgtctccgggctgcagcccgaggacgaggccgactacttctgctgcgcctacggcgggaagtacctcgtggtgttcggcgggggcacgaaggtcaccgtgctg

SEQ ID NO: 12441 - RNA, 330 nt, synthetic construct
  misc_feature 1..330: note = derived and/or modified sequence opt1 from anti-influenza_Chain
  source 1..330: mol_type = other RNA
cagagcgccctgacccagcccgcctccgtgagcggctccccggggcagagcatcaccatctcctgcacgggcaccagctccgacgtcgggggctacaactacgtgagctggtaccagcagcaccccgggaaggcgcccaagctcctgatctacgaggtgaccaactggccctccggcgtcagcaaccgcttctccggcagcaagtccgggaacaccgccagcctgacgatctccggcctccaggccgaggacgaggccgactactactgcagctcctacgccgggagctccacctgggtgttcggcgggggcacccgggtgaccgtcctg

SEQ ID NO: 12442 - RNA, 330 nt, synthetic construct
  misc_feature 1..330: note = derived and/or modified sequence opt1 from anti-influenza_Chain
  source 1..330: mol_type = other RNA
cagaccgtggtcacccaggagcccagcctgacggtgtccccgggcgggaccgtgaccctgacctgcgccagctccacgggcgccgtcaccagctcctacttccccaactggttccagcagaagcccgggcaggcgccccgcccgctcatctacagcaccaccatccggcactcctggacgcccgcccgcttcagcggctccctgctcgggggcaaggccgccctgaccctgagcggcgtgcagcccgaggacgaggccgactactactgcctcctgtactccgggggcgaccccgtggcgttcgggggcgggaccaagctgaccgtcctc

SEQ ID NO: 12443 - RNA, 330 nt, synthetic construct
  misc_feature 1..330: note = derived and/or modified sequence opt1 from anti-influenza_Chain
  source 1..330: mol_type = other RNA
cagagcgtgctgacccagtcccccagcgtctccgccgccccgggccagaaggtgaccatcagctgctccgggagcgactccaacatcggcgactacttcgtgtgctggtaccagcacctccccgggaagccgccccagctgctgatctacgagaacaacaagcgccccagcggcatccccgaccggttctccgggagcaagtccggcacgagcgcgaccctcggcatcaccgggatccagaccggcgacgaggccgactactactgcgccacgtgggacgggtccctgagcgcctgggtcttcggcgggggcaccaagctgaccgtgctc

SEQ ID NO: 12444 - RNA, 330 nt, synthetic construct
  misc_feature 1..330: note = derived and/or modified sequence opt1 from anti-influenza_Chain
  source 1..330: mol_type = other RNA
cagagcgccctgacccagccccgctccgtgagcggctccccggggcagagcatcaccatctcctgcacgggcgggagctccgacatcggcgccagcaactccgtcagctggtaccagcagcaccccgggaaggcgcccaagctcgtgatcttcgacgtgaccgagcggccctccggcgtcccgcaccgcttcagcggctccaagagcgggaacaccgcctccctgaccgtgagcggcctgcagcccgacgacgaggccgactacttctgctgcgcctacgggggcaagtacctcgtggtcttcgggggcggcacgaaggtgaccgtgctg

SEQ ID NO: 12445 - RNA, 330 nt, synthetic construct
  misc_feature 1..330: note = derived and/or modified sequence opt1 from anti-influenza_Chain
  source 1..330: mol_type = other RNA
caggccgtggtcacccaggagcccagcctggccgtgtccccgggcgggaccgtgacgctgacctgcggcagctccaccggggcggtcacccgcggccactacccctactggttccagcagaagcccgggcaggcgccccgggccctcatctacgacagcgccggcaaccgccactcctggacgccggcccggttcagcggctccctgctcgggggcaaggccgccctgaccctgagcggggcccagcccgaggacgaggccgagtactactgcctcctgtcctacagcggcgtgtgggtgttcgggggcggcaccaagctgaccgtcctc

SEQ ID NO: 12446 - RNA, 330 nt, synthetic construct
  misc_feature 1..330: note = derived and/or modified sequence opt1 from anti-influenza_Chain
  source 1..330: mol_type = other RNA
gagatcgtgatgacccagagccccgccaccctgtccgtcagcccgggcgagcgcgtgacgctctcctgccgggccagccagtccatcaccgacgggctggcgtggtaccagcagaagtccggccaggcgccccgcctgctcatctacggggccagcacccgggccaccggcatccccgcccgcttcagcgggtccggcagcggcacggagttcaccctgaccatctccagcctgcagtccgaggacttcgccgtgtactactgccagcagtacaacaactggcccccggtcaccttcgggcagggcacgaaggtggagatcaagcggacc

SEQ ID NO: 12447 - RNA, 330 nt, synthetic construct
  misc_feature 1..330: note = derived and/or modified sequence opt1 from anti-influenza_Chain
  source 1..330: mol_type = other RNA
agctccgagctgacccagcccccgagcgcctccggcacccccgggcagcgcgtgacgatcagctgctccggcagcacctccaacatcgggtacaaccccgtcagctggtaccagcaggtccccggcaccgccccgaagctcctgatctactccaacaccgagcggcccagcggggtgcccgaccgcttctccggcagcaagtccggcacgagcgcgtccctggccatcagcgggctccagtccgaggacgaggccgactactactgcgccgcctgggacgacaccctgaacggccccgtgttcgggggcgggaccaaggtgaccgtgctg

SEQ ID NO: 12448 - RNA, 330 nt, synthetic construct
  misc_feature 1..330: note = derived and/or modified sequence opt1 from anti-influenza_Chain
  source 1..330: mol_type = other RNA
cagagcgccctgacccagcccgcctccgtgagcggctccccggggcagagcatcaccatctcctgcacgggcaccagctccgacgtcgggggctacaactacgtgagctggtaccagcagcaccccggggaggcgcccaagctcatgatctccgacgtgagcaaccgcccctccggcgtcagcaaccggttctccggcagcaagtccgggaacaccgccagcctgaccatctccggcctgcaggccgaggacgaggccgactactactgcacgagctacacctccagcaacaccctcgtgttcgggggcgggaccaagctgacggtgctg

SEQ ID NO: 12449 - RNA, 330 nt, synthetic construct
  misc_feature 1..330: note = derived and/or modified sequence opt1 from anti-influenza_Chain
  source 1..330: mol_type = other RNA
cagagcgtgctgacccagcccccgtccgtcagcgccgcccccggccagaaggtgaccatctcctgcagcgggtccagctccaacatcggccacaacttcgtgagctggtaccagcagctccccgcgacggcccccaagctgctgatctacgacaccgacaagcgcccgtccgggatccccgaccggttcagcggctccaagagcgggacctccgccaccctcggcatcacgggcctgcagaccggggacgaggccgactactactgcggcacctgggacagctccctgagctccgtcatcttcgggggcgggaccaagctcacggtgctg

SEQ ID NO: 12450 - RNA, 330 nt, synthetic construct
  misc_feature 1..330: note = derived and/or modified sequence opt1 from anti-influenza_Chain
  source 1..330: mol_type = other RNA
gacatccagatgacccagagcccctccaccctgagcgcctccgtgggcgaccgcgtcacgatcacgtgccgggccagccagaccatcaacaactacctcgcgtggtaccagcagaagccggggaaggcccccaagctgctgatctacaaggcctccagcctcgagtccggcgtgcccagccgcttctccgggagcggctccgggaccgagttcaccctgaccatcagctccctgcagcccgacgacttcgccacctactactgccaggagtacaacaacgacagcccgctcaccttcggcggcgggacgaaggtggagatcaagcggacc

SEQ ID NO: 12451 - RNA, 330 nt, synthetic construct
  misc_feature 1..330: note = derived and/or modified sequence opt1 from anti-influenza_Chain
  source 1..330: mol_type = other RNA
gacatcgagctgacccaggaccccagcgtgtccgtcgccccgggccagaccgcccgcatcccctgcgtgcggttcaacatggggcccacgagcgtgcactggtaccagcagaagcccggccaggcgccggtcctcgtggtgtacgacgactccgaccgccccagcgggatccccgagcggttctccggcagcaactccggggacagcgccaccctgaccatctcccgcgtcgaggccggcgacgaggccgactactactgccaggtgtgggacatgagctccgaccggcgcgtgttcggcgggggcaccacgctgaccgtcctcgggcag

SEQ ID NO: 12452 - RNA, 330 nt, synthetic construct
  misc_feature 1..330: note = derived and/or modified sequence opt1 from anti-influenza_Chain
  source 1..330: mol_type = other RNA
gacatcgtgatgacccagagccccggcaccctgtccctcagcccgggggagcgcgccacgctgtactgccgggcctcccagagcgtccgctccggctacctggcctggtaccagcacaagcccgggcaggcgcccctcctgctgttctacgacgccagcggccgggccaccgggatccccgaccgcttctccggcagcggctccgggaccgacttcaccctcacgatcagccggctggagccggaggacttcgccgtgtactactgcctgcagtacggctccagcccccgcaccttcgggcagggcaccaaggtggagatcaagcggacc

SEQ ID NO: 12453 - RNA, 330 nt, synthetic construct
  misc_feature 1..330: note = derived and/or modified sequence opt1 from anti-influenza_Chain
  source 1..330: mol_type = other RNA
gacatcgtgctgacccagagcccctccttcctcagcgcctccgtcggcgaccgcgtgaccatcacgtgccgggccagccagctgatctccagctacttcgcgtggtaccagcagaagcccgggaagccgcccaagctgctcatctacgccgcctccaccctgcagagcggcgtgccctcccgcttcagcgggtccggcagcgggacccagttctccctgaccatcagctccctccagcccgaggacttcgccacgtactactgccagcagctgaacagctacccgcccatcaccttcggccagggcacccggctggagatcaagcgcacc

SEQ ID NO: 12454 - RNA, 330 nt, synthetic construct
  misc_feature 1..330: note = derived and/or modified sequence opt1 from anti-influenza_Chain
  source 1..330: mol_type = other RNA
gacatcaccctgacccagagccccgccacgctctccgtgagcccgggcgagcgcgccaccctgtcctgccgggcgagccagtccgtcagctccaacctggcctggtaccagcagaagcccgggcaggcgccccgcctcctgatctacggcgccagcaaccgggccaccgacatccccgcccgcttctccgggagcggctccgggaccgagttcacgctgaccatcagctccctccagagcgaggacttcgccgtgtactactgccagcagttcaacgactggccgttcctgaccttcggcggcgggaccaaggtggagatcaagcggacg

SEQ ID NO: 12455 - RNA, 330 nt, synthetic construct
  misc_feature 1..330: note = derived and/or modified sequence opt1 from anti-influenza_Chain
  source 1..330: mol_type = other RNA
gacatcgtgatgacccagagcccctccttcctgagcgcctccgtcggcgaccgcgtgaccatcacgtgccggaccagccaggtgatctccagctacctcgcctggtaccagcagcgcccggggaaggcgcccaagctgctgatctacgccgcctccaccctccagagcggcgtcccctcccggttcagcgggtccggcagcgggacccgcttctccctgacgatcagcaacctgcagcccgaggacttcgccacctacttctgccagcagctcaccacctacccgcccatcacgttcggccagggcacccggctggagatcaagcgcacc

SEQ ID NO: 12456 - RNA, 330 nt, synthetic construct
  misc_feature 1..330: note = derived and/or modified sequence opt1 from anti-influenza_Chain
  source 1..330: mol_type = other RNA
gacatcgtgctgacccagagcccctccgtcagcgtggccccgggccagaccgcccgcatcacgtgcgggggcaacgacatcgggtccaagagcgtgcactggtaccagcagaagcccggccaggcgcccgtcctcgtggtgttcgacgaccgggaccgcccctccgggatcccggagcggttcagcggctccaacagcggcaacaccgccaccctgaccatctcccgcgtcgaggccggggacgaggccgactactactgccaggtgtgggacatcacgagcgacctggtggtcttcggcgggggcaccaagctcaccgtggtggggcag

SEQ ID NO: 12457 - RNA, 330 nt, synthetic construct
  misc_feature 1..330: note = derived and/or modified sequence opt1 from anti-influenza_Chain
  source 1..330: mol_type = other RNA
gacatcgtgatgacccagcccccgggcaccctgagcgtctcccccggggagcgcgccacgctcagctgccgggcctcccagagcgtgtccaccaacctggcgtggtaccagcagaagcccggccaggcgccccgcctgctcatccacggggccagcacccgggccaccggcatcccggcccgcttctccgggagcggctccggcgccgagttcacgctgaccatcagctccctgcagagcgaggacgtggccgtctactactgccagcagtacgacaactggctccccatcaccttcgggcccggcaccaaggtggacatccagcggacg

SEQ ID NO: 12458 - RNA, 330 nt, synthetic construct
  misc_feature 1..330: note = derived and/or modified sequence opt1 from anti-influenza_Chain
  source 1..330: mol_type = other RNA
gaccccatgctgacccagaccgccagccccgtgtccgccgcggtcggcgggacggtgaccatcaactgccaggccagccagtccgtgtacaacaagaacaacctcgcctggtaccagcagaagctgggccagccgcccaagctgctcatctacgccgccagcaccctgacctccggggtccccagccgcttcaagggctccgggagcggcacgcagttcaccctgaccatctccgacctcgagtgcgacgacgcggccacctactactgcgccggcgactacagcgggggcatctacgccttcgggggcgggacgaaggtggagatcaag

SEQ ID NO: 12459 - RNA, 330 nt, synthetic construct
  misc_feature 1..330: note = derived and/or modified sequence opt1 from anti-influenza_Chain
  source 1..330: mol_type = other RNA
gagctggtgatgacccagacccccgccagcgtctccgccgcggtgggcgggacggtgaccatcagctgccagtccagcgagtccgtctacaagaacaacaacctcgcctggttccagcagaagctgggccagccgcccaagctgctcatctacgacgccagcaagctggcctccggggtgcccagccgcttctccggcagcgggtccggcacccagttcaccctgacgatcagcgacctcgagtgcgacgacgccgcgacctactactgcgccggcgactactccgggagcaactacgccttcggcgggggcaccaagctggagatcaag

SEQ ID NO: 12460 - RNA, 330 nt, synthetic construct
  misc_feature 1..330: note = derived and/or modified sequence opt1 from anti-influenza_Chain
  source 1..330: mol_type = other RNA
gagcccatgctgacccagaccgccagctccgtgagcgccgcggtcggcgggtccgtgacgatcagctgccagtccagccagtccgtggacagcaacaaccagctctcctggtaccagcagaagcccggccagccgcccaagctgctgatctacgccgccagcaccctcacctccggggtccccagccgcttcaagggctccgggagcggcacccagttcacgctgaccatctccgacctggagtgcgacgacgccgccacctactactgcgcgggcgactacagcgggggcatctacgccttcgggggcgggaccgaggtggtggtcaag

SEQ ID NO: 12461 - RNA, 330 nt, synthetic construct
  misc_feature 1..330: note = derived and/or modified sequence opt1 from anti-influenza_Chain
  source 1..330: mol_type = other RNA
gaccccatgctgacccagaccgccgccagcgtgtccgcggccgtcggcgggacggtgaccatcagctgccagtccagcgagtccgtgtacaagaacaacaacctcgcctggttccagcagaagctgggccagccgcccaccctgctcatctgggacgccagcaagctggcctccggggtccccagccgcttctccggcagcgggtccggcacccagttcacgctgaccatcagcgacctcgagtgcgacgacgcggccacctactactgcgccggcgactactccggggtgaactacgccttcggcgggggcaccgaggtggtcgtgaag

SEQ ID NO: 12462 - RNA, 330 nt, synthetic construct
  misc_feature 1..330: note = derived and/or modified sequence opt1 from anti-influenza_Chain
  source 1..330: mol_type = other RNA
gagctggtgatgacccagacccccgccagcgtctccgccgcggtgggcgggacggtgaccatcagctgccagtccagcgagtccgtctacaagaacaacaacctcgcctggttccagcagaagctgggccagccgcccaagctgctcatctacgacgccagcaagctggcctccggggtgcccagccgcttctccggcagcgggtccggcacccagttcaccctgacgatcagcgacctcgagtgcgacgacgccgcgacctactactgcgccggcgactactccgggagcaactacgccttcggcgggggcaccgaggtggtcgtgaag

SEQ ID NO: 12463 - RNA, 330 nt, synthetic construct
  misc_feature 1..330: note = derived and/or modified sequence opt1 from anti-influenza_Chain
  source 1..330: mol_type = other RNA
gaccccatgctgacccagaccgccagctccgtgagcgccacggtcggcgggaccgtgaccatctcctgccagagctcccagagcgtggacaacaacaaggacctcgcgtggttccagcagaagccgggccactcccccaagctgctgatctacttcgccagccgcctcgcctccggggtccccagccggttcaagggctccgggagcggcacccacttcacgctgaccatctccgacctggagtgcgacgacgccgccacctactactgcgcgggcgactacagcggggccaactacgccttcggcgggggcaccaagctcgagatcaag

SEQ ID NO: 12464 - RNA, 330 nt, synthetic construct
  misc_feature 1..330: note = derived and/or modified sequence opt1 from anti-influenza_Chain
  source 1..330: mol_type = other RNA
gaccccatgctgacccagaccgccagccccgtgtccgccgcggtcggcgggacggtgaccatcaactgccagagctcccagagcgtgtacaacaacaaccgcctctcctggttccagcagaagcccggccagccgcccaagctgctgatctacagcgcctccaccctcgccagcggggtctccagccggttcaagggctccgggagcggcacccagttcacgctgaccatctccgacctggagtgcgacgacgccgccacctactactgcgcgggcgactacagcgggggcatctacgccttcgggggcgggaccgagctcgagatcctg

SEQ ID NO: 12465 - RNA, 330 nt, synthetic construct
  misc_feature 1..330: note = derived and/or modified sequence opt1 from anti-influenza_Chain
  source 1..330: mol_type = other RNA
gagctggtgctcacccagacccccgccagcgtctccgccgcggtgggcgggacggtgagcatctcctgccagagctcccagagcgtctacaagaacaacaacctggcctggttccagcagaagctgggccagccgcccaccctcctgatctgggacgcctccaagctggccagcggggtgccctcccgcttcagcggctccgggagcggcacccagttcaccctcacgatctccgacctggagtgcgacgacgccgcgacctactactgcgccggcgactacagcggggtgaactacgccttcggcgggggcaccaagctggagatcaag

SEQ ID NO: 12466 - RNA, 330 nt, synthetic construct
  misc_feature 1..330: note = derived and/or modified sequence opt1 from anti-influenza_Chain
  source 1..330: mol_type = other RNA
gagctggacctcacccagacccccgccagcgtgtccgccgcggtcggcgggacggtgaccatcagctgccagtccagcgagtccgtgtacaagaacaacaacctggcctggttccagcagaagctgggccagccgcccaccctcctgatctgggacgccagcaagctggcctccggggtccccagccgcttctccggcagcgggtccggcacccagttcacgctcaccatcagcgacctggagtgcgacgacgccgcgacctactactgcgccggcgactactccggggtgaactacgccttcggcgggggcaccgaggtggtcgtgaag

SEQ ID NO: 12467 - RNA, 330 nt, synthetic construct
  misc_feature 1..330: note = derived and/or modified sequence opt1 from anti-influenza_Chain
  source 1..330: mol_type = other RNA
gacatccagatgacccagagcccctccagcctgtccgccagcgtgggcgaccgcgtcaccatcacgtgccagtccagcgagtccgtgtacaagaacaacaacctcgcctggtaccagcagaagccggggaagccgcccaagctgctgatctgggacgcgagcaagctcgcctccggcgtgcccagccggttctccgggagcggctccgggaccgacttcaccctgaccatcagctccctgcagcccgaggacgtcgccacgtactactgcgccggcgactacagcggcgtgaactacgccttcgggggcgggaccgaggtggtcgtgaag

SEQ ID NO: 12468 - RNA, 333 nt, synthetic construct
  misc_feature 1..333: note = derived and/or modified sequence opt1 from anti-influenza_Chain
  source 1..333: mol_type = other RNA
gacatcgtgatgacccagagccccgactccctggccgtcagcctcggcgagcgcgccaccatcaactgcaagtccagccagtccgtgacgttcaacaacaagaactacctggcgtggtaccagcagaagcccgggcagccgcccaagctgctcatctactgggccagcacccgggagtccggcgtgcccgaccgcttcagcgggtccggcagcgggaccgacttcaccctgacgatctccagcctgcaggccgaggacgtcgccgtgtactactgccagcagcactaccggaccccgcccaccttcggccagggcaccaaggtggagatcaag

SEQ ID NO: 12469 - RNA, 333 nt, synthetic construct
  misc_feature 1..333: note = derived and/or modified sequence opt1 from anti-influenza_Chain
  source 1..333: mol_type = other RNA
cagagcgccctgacccagcccgcctccgtgagcggctccccggggcagagcatcaccatctcctgcacgggcaccgggagcgacgtcggctccagcaacctcgtgtcctggtaccagcagcaccccgcgaaggcccccaagctgatcatctacgaggtgaccaagcgccccagcggggtctccaaccggttcagcggctccaagagcggcaacaccgcctccctgacgatcagcgggctccaggccgaggacgaggccgactactactgctgctcctacgcgggcagctccagcagccgcgtgttcgggaccggcaccaaggtgaccgtcctg

SEQ ID NO: 12470 - RNA, 333 nt, synthetic construct
  misc_feature 1..333: note = derived and/or modified sequence opt1 from anti-influenza_Chain
  source 1..333: mol_type = other RNA
cagagcgtgctgacccagcccccgtccgccagcggcacccccgggcagcgcgtcacgatctcctgcagcggctccaccagcaacatcgggtccaacgccgtgaactggtaccagcagctccccggcaccgcgcccaagctgctgatctacagcaacaaccagcggccgtccggggtgcccgaccgcttcagcggctccaagagcggcacctccgccagcctcgccatctccgggctgcagagcgaggacgaggccgactactactgcgccgcgtgggacgactccctgagcggctcctgggtcttcgggggcgggacgaagctcaccgtgctg

SEQ ID NO: 12471 - RNA, 333 nt, synthetic construct
  misc_feature 1..333: note = derived and/or modified sequence opt1 from anti-influenza_Chain
  source 1..333: mol_type = other RNA
gagaccaccctgacgcagagccccggcaccctctccctgagcccgggggagcgcgccaccctgtcctgccgggtgagccagtccgtcagctccaactacctcgcctggtaccagcagaagcccggccaggcgccccgcctgctgatctacggggccagctcccgggccaccggcatccccgaccgcttcagcgggtccggcagcggcacggacttcaccctcaccatctcccggctggagccggaggacttcgccgtgtactactgccagcagtacgggaccagcccccgcgccttcggccacgggacgaaggtggagatcaagcggaccgtc

SEQ ID NO: 12472 - RNA, 333 nt, synthetic construct
  misc_feature 1..333: note = derived and/or modified sequence opt1 from anti-influenza_Chain
  source 1..333: mol_type = other RNA
cagagcgtgctgacccagcccccgtccgtcagcggcgcccccgggcagcgcgtgaccatctcctgcggcgggagccggtccaacatcggcgccgggtacgacgtgcactggtaccagcagttccccggcacggcgcccaaggtcgtgatctacggcaacaacaaccgcccgagcggggtgcccgaccggttctccggcagcaagtccgggaccagcgcctccctcgccatcaccggcctgcaggccgaggacgaggccaactactactgccagagctacgacaccaacctcgggggctccatcttcggcgggggcacgcaggtcaccgtgctg

SEQ ID NO: 12473 - RNA, 333 nt, synthetic construct
  misc_feature 1..333: note = derived and/or modified sequence opt1 from anti-influenza_Chain
  source 1..333: mol_type = other RNA
aacttcatgctgacccagccccacagcgtgtccgagagcccgggcaagaccgtcacgatctcctgcaccgggagctccggcagcatcgcctccaactacgtgcagtggtaccagcagcgccccgggagcgcccccaccaccgtgatctacgaggactaccagcggccctccggcgtcccggaccgcttcagcgggtccatcgacagctccagcaactccgcgagcctcacgatctccggcctgaagaccgaggacgaggccgactactactgccagagctacgacgactccgaccacctgatcttcggcgggggcaccaagctcaccgtgctg

SEQ ID NO: 12474 - RNA, 333 nt, synthetic construct
  misc_feature 1..333: note = derived and/or modified sequence opt1 from anti-influenza_Chain
  source 1..333: mol_type = other RNA
cagagcatgctgacccagcccccgtccgccagcggcacccccgggcagcgcgtgacgatctcctgcagcggctccagctccaacatcgggagcaacaccgtcaactggttcaagcacctccccggcaccgcccccaagctgctgatctaccggaacgacctccgcccgtccggggtgcccgaccggttcagcggctccaagagcggcacctccgcgagcctggccatctccgggctgcagagcgaggacgaggccgactactactgcgccacgtgggacgactccctcaacggcttctacgtgttcgggaccggcaccaaggtcaccgtgctg

SEQ ID NO: 12475 - RNA, 333 nt, synthetic construct
  misc_feature 1..333: note = derived and/or modified sequence opt1 from anti-influenza_Chain
  source 1..333: mol_type = other RNA
gacatccagctgacccagagcccctccagcctctccgccagcgccggcgaccgcgtgtccatgacctgccgggcgagccagatcatctccagctccctgaactggtaccagcagaagccggggaaggcccccaagctgctcatctacgccgccagcaacctgcagtccggcgtccccagccgcttctccgggagcggctccgggacggacttcaccctgaccatcagctccctccagcccgaggacttcgccacctactactgccagcagagctactccacgccgcccgagctgaccttcggcggcgggaccaaggtggacatcaagcggacc

SEQ ID NO: 12476 - RNA, 333 nt, synthetic construct
  misc_feature 1..333: note = derived and/or modified sequence opt1 from anti-influenza_Chain
  source 1..333: mol_type = other RNA
agctacgtgctgacccagcccccgtccgccagcggcacccccgggcagcgcgtcacgatctcctgcagcggctccaccttcaacatcgggagcaacgccgtggactggtaccggcagctccccggcaccgcgcccaagctgctgatctactccaacaaccagcgcccgagcggggtgcccgaccggttctccggcagccgctccggcaccagcgcctccctcgccatcagcgggctgcagtccgaggacgaggccgactactactgcgccgcgtgggacgacatcctgaacgtccccgtgttcggcgggggcacgaagctcaccgtgctgggg

SEQ ID NO: 12477 - RNA, 333 nt, synthetic construct
  misc_feature 1..333: note = derived and/or modified sequence opt1 from anti-influenza_Chain
  source 1..333: mol_type = other RNA
cagagcgccctgacccagcccgccgcggtgtccggcagcccggggcagtccatcaccatcagctgcacgggcacctccagcgacgtcgggggctacaactacgtgtcctggtaccagcagcaccccgggaaggcccccaagctcatgatctacgaggtgagcaaccgcccctccggcgtcagcaaccggttctccggcagcaagtccgggaacaccgccagcctgaccatctccggcctgcaggccgaggacgaggccgactactactgcagctcctacacgagctccagcacctacgtgttcgggaccggcaccaaggtgacggtcctcggg

SEQ ID NO: 12478 - RNA, 333 nt, synthetic construct
  misc_feature 1..333: note = derived and/or modified sequence opt1 from anti-influenza_Chain
  source 1..333: mol_type = other RNA
agctacgtgctgacccagcccccgtccgtcagcggcacccccgggcagcgcgtgacgatctcctgcagcggctcccggagcaacgtgggggacaactccgtctactggtaccagcacgtgcccgagatggcccccaagctcctggtgtacaagaacacccagcgcccgagcggcgtccccgcccggttctccgggagcaagtccggcaccagcgcgtccctggccatcatcggcctccagagcggggacgaggccgactactactgcgtggcctgggacgactccgtggacggctacgtcttcgggagcggcaccaaggtgacggtgctgggg

SEQ ID NO: 12479 - RNA, 333 nt, synthetic construct
  misc_feature 1..333: note = derived and/or modified sequence opt1 from anti-influenza_Chain
  source 1..333: mol_type = other RNA
agcgtgctgacccagcccccgtccgtcagcgccgcccccggccagaaggtgaccatctcctgcagcgggtccagctccaacatcggcaacgactacgtgagctggtaccagcagctccccgggacggcgcccaagctgctgatctacgacaacaacaagcgcccgtccggcatccccgaccggttcagcgggtccaagagcggcacctccgccaccctcggcatcaccgggctgcagacgggcgacgaggccaactactactgcgccacctgggaccgccggcccaccgcctacgtcgtgttcgggggcgggaccaagctgacggtgctcggc

SEQ ID NO: 12480 - RNA, 333 nt, synthetic construct
  misc_feature 1..333: note = derived and/or modified sequence opt1 from anti-influenza_Chain
  source 1..333: mol_type = other RNA
cagagcgccctgacccagccccgctccgtgagcggctccccggggcagagcgtcaccatctcctgcacgggcaccagctccgacgtcgggggctacaactacgtgagctggtaccagcagcaccccgggaaggcccccaagctcatgatctacgacgtgtccaagcggcccagcggcgtgccggaccgcttctccggcagcaagtccgggaacaccgcgagcctgaccatctccggcctgcaggccgaggacgaggccgactactactgcagctcctacacgagctccagcacccacgtgttcgggaccggcaccaaggtcacggtgctcggg

SEQ ID NO: 12481 - RNA, 333 nt, synthetic construct
  misc_feature 1..333: note = derived and/or modified sequence opt1 from anti-influenza_Chain
  source 1..333: mol_type = other RNA
agctacgtgctgacccagcccccgtccgccagcggcacccccgggcagcgcgtcacgatctcctgcagcggctccagctccaacatcgggagcaactacgtgtactggtaccagcagctccccggcaccgcccccaagctgctgatctaccgggacgggcagcgcccgtccggcgtgcccgaccggttcagcggctccaagagcgggacctccgcgagcctcgccatctccggcctgcgcagcgacgacgaggccgactactactgcgccacctgggacgacaacctgtccgggcccgtcttcggcgggggcacgaagctcaccgtgctgggc

SEQ ID NO: 12482 - RNA, 333 nt, synthetic construct
  misc_feature 1..333: note = derived and/or modified sequence opt1 from anti-influenza_Chain
  source 1..333: mol_type = other RNA
cagagcgccctgacccagcccgcctccgtgagcggctccccggggcagagcatcaccatctcctgcacgggcaccagctccgacgtcgggggctacaactacgtgagctggtaccagcagcaccccgggaaggcgcccaagctcatgatctacgaggtgtccaaccgccccagcggcgtctccaaccggttcagcggctccaagagcgggaacaccgcctccctgaccatcagcggcctgcaggccgaggacgaggccgactactactgctccagctacacgtccagcagcaccctcgtgttcgggaccggcaccaaggtgacggtcctgggg

SEQ ID NO: 12483 - RNA, 333 nt, synthetic construct
  misc_feature 1..333: note = derived and/or modified sequence opt1 from anti-influenza_Chain
  source 1..333: mol_type = other RNA
accgtgctgacccagcccccgagcgtctccggcgcccccgggcagcgcgtgacgatcagctgcaccggctccagctccaacatcggggccggctacgacgtgcactggtaccagcagctccccgggaccgcgcccaagctgctgatctacggcaacagcaaccggccgtccggcgtccccgaccgcttcagcgggtccaagagcggcacctccgccacgctcgggatcaccggcctgcagaccggggacgaggccgactactactgcggcacctgggacagctccctgagcgcctacgtgttcggcacggggaccaaggtgaccgtcctcggc

SEQ ID NO: 12484 - RNA, 333 nt, synthetic construct
  misc_feature 1..333: note = derived and/or modified sequence opt1 from anti-influenza_Chain
  source 1..333: mol_type = other RNA
ggcagcgccctgacccagccccgctccgtgagcgggtccccgggccagagcgtcaccatctcctgcacggggaccagctccgacgtgggcgggtacaactacgtgagctggtaccagcagcaccccggcaaggcccccaagctcatgatctacgacgtctccaagcggcccagcggcgtgccggaccgcttctccgggagcaagtccggcaacaccgcgagcctgaccatctccgggctgcaggccgaggacgaggccgactactactgcagctcctacacgagctccagcacccacgtgttcggcaccgggaccaaggtcacggtgctcggc

SEQ ID NO: 12485 - RNA, 333 nt, synthetic construct
  misc_feature 1..333: note = derived and/or modified sequence opt1 from anti-influenza_Chain
  source 1..333: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatcttcggggcctccacccgggccaccggcatccccgaccgcttcagcgggtccggcagcggcaccgacttcacgctcaccatctcccggctggagccggaggacttcgccgtgttctactgccagcagtacgggagcctgcccctcaccttcggcgggggcaccaaggtggagatcaaggggacggtc

SEQ ID NO: 12486 - RNA, 333 nt, synthetic construct
  misc_feature 1..333: note = derived and/or modified sequence opt1 from anti-influenza_Chain
  source 1..333: mol_type = other RNA
gagatcgtgctgacccagagccccggcaccctctccctgagcccgggggagcgcgccacgctgtcctgccgggccagccagtccgtccgcagcaacaacctcgcgtggtaccagcacaagcccggccaggcgccccggctgctgatcttcggggcctccagccgcgccaccggcatccccgaccggttctccgggagcggctccggcaccgacttcaccctcacgatcagccgcctggagccggaggacttcgccgtgtactactgccagcagtacgggtccagccccgccctgaccttcggcgggggcaccaaggtggagatcaagcggacc

SEQ ID NO: 12487 - RNA, 333 nt, synthetic construct
  misc_feature 1..333: note = derived and/or modified sequence opt1 from anti-influenza_Chain
  source 1..333: mol_type = other RNA
cagagcctggaggagtccggcgggggcctcgtgaagcccgggggcagcctgaccctgacctgcacggtctccgggctcagcctgtactccaacgagatcaactgggtgcgccaggccccgggcaacggcctggagtggatcggggccatcgcgggcagcgggtccgccgactacgccagctgggccaagggccggtccaccatcacccgcaacaccgacctcaacacggtgaccctgaagatgaccagcctgaccgccgcggacacggccacctacttctgcgcctccttctgggacctctgggggcccggcaccctggtcaccgtgagctcc

SEQ ID NO: 12488 - RNA, 333 nt, synthetic construct
  misc_feature 1..333: note = derived and/or modified sequence opt1 from anti-influenza_Chain
  source 1..333: mol_type = other RNA
cagagcgtggaggagtccggcgggggcctggtcaagcccgggggcagcctcaccctgacctgcacggtgtccgggctgagcctctactccaacgagatcaactgggtgcgccaggccccgggcaacggcctggagtggatcggggccatcgcgggcagcgggtccgccgactacgccagctgggccaagtcccggagcaccatcacccgcaacaccaacctgaacacggtcaccctcaagatgacctccctgaccgccgcggacacggccacctacttctgcgccagcttctgggacctgtggggccccgggaccctcgtgaccgtgtccagc

SEQ ID NO: 12489 - RNA, 333 nt, synthetic construct
  misc_feature 1..333: note = derived and/or modified sequence opt1 from anti-influenza_Chain
  source 1..333: mol_type = other RNA
cagagcctggaggagtccggcgggggcctcgtgaagcccgggggcagcctgaccctgacctgcacggtctccgggctcagcctgtactccaacgagatcaactgggtgcgccaggccccgggcaacggcctggagtggatcggggccatcgcgggcagcgggtccgccgactacgccagctgggccaagtcccggagcaccatcacccgcaacaccaacctcaacacggtgaccctgaagatgacctccctgaccgccgcggacacggccacctacttctgcgccagcttctgggacctctggggccccgggaccctggtcaccgtgtccagc

SEQ ID NO: 12490 - RNA, 333 nt, synthetic construct
  misc_feature 1..333: note = derived and/or modified sequence opt1 from anti-influenza_Chain
  source 1..333: mol_type = other RNA
aacatcgtgctgacccagagccccgcctccctcgccgtcagcctgggccagcgcgcgaccatctcctgccgggccagcgagtccgtggacatctacgggaacagcttcatgcactggtaccagcagaagccgggccagccgcccaagctgctcatctacctggcctccaagctggagtgcggggtgtgcgcccgcttcaacggcagcgggtgccggacggacttcaccctcgccatcgaccccgtcgagggcgacgacggcgcgacctactactgccagcagaactacgaggacccctggaccttcgggggcgggacgaagctggagatcaag

SEQ ID NO: 12491 - RNA, 333 nt, synthetic construct
  misc_feature 1..333: note = derived and/or modified sequence opt1 from anti-influenza_Chain
  source 1..333: mol_type = other RNA
aacatcgtgctgacccagagccccgcctccctcgccgtcagcccgggccagcgcgcgaccatctcctgccgggccagcgagtccatcgacatctacgggaacagcttcatgcactggtaccagaagaagcccggccagccgcccaagctgctgatctaccgcgcctccaacctcgagagcggggtgcccgcccggttcaacggctccgggagccgcacggacttcaccctgaccatcgaccccgtggagggcgacgacggcgccacctactactgccagcagaactacgaggacccctggacgttcgggggcgggaccaagctggagatcaag

SEQ ID NO: 12492 - RNA, 333 nt, synthetic construct
  misc_feature 1..333: note = derived and/or modified sequence opt1 from anti-influenza_Chain
  source 1..333: mol_type = other RNA
gagatcgtgctgacccagagccccgccaccctctccctgtacccgggcgagcgcgccacgctgagctgccgggcgtcccagagcgtctcccgctacctcgcctggtaccagcagaagcccgggcaggcgccccggctgctgatctacgacgccagcaaccgcgccaccggcatccccgcccggttctccgggagcggctccgggaccgacttcaccctcacgatcagctccctggagccggaggacttcgccgtgtactactgccagcagcgcagcaactggctgaagatcaccttcggccagggcacccggctcgagatcaaggggaccgtg

SEQ ID NO: 12493 - RNA, 336 nt, synthetic construct
  misc_feature 1..336: note = derived and/or modified sequence opt1 from anti-influenza_Chain
  source 1..336: mol_type = other RNA
gacatcgtgatgacccagagccccgactccctggccgtcagcctcggcgagcgcgccaccatcaactgcaagtccagccagtccgtgctgtacagctccaacaacaagaactacctggcgtggtaccagcagaagccggggcagccgcccaagctcctgatcgactgggccagcacgcgggagtccggcgtgcccgaccgcttcagcgggtccggcagcgggaccgacttcaccctgaccatctccaacctccaggtcgaggacgtggccgtgtactactgccagcagtactaccggagcccctccttcggccagggcacgaagctggagatcaag

SEQ ID NO: 12494 - RNA, 336 nt, synthetic construct
  misc_feature 1..336: note = derived and/or modified sequence opt1 from anti-influenza_Chain
  source 1..336: mol_type = other RNA
gacatcgtgatgacccagacgcccctgagcctctccgtcaccccgggccagcccgccagcatctcctgcaagagctcccagagcctgctgcactccgacgggaagacctacctctactggtacctgcagaagcccggccagagcccccagctgctcatctacgaggtgtccaaccgcttcagcggggtgccggaccggttctccggcagcgggtccggcaccgacttcaccctgaagatcagccgcgtcgaggccgaggacgtgggcgtgtactactgcatgcagaacatcctgctccccctgacgttcgggggcgggaccaaggtcgagatcaag

SEQ ID NO: 12495 - RNA, 336 nt, synthetic construct
  misc_feature 1..336: note = derived and/or modified sequence opt1 from anti-influenza_Chain
  source 1..336: mol_type = other RNA
gagatcgtgatgacccagacgcccctgagcctctccgtcaccccgggccagcccgccagcatctcctgccgcagctcccagagcctgctgcactccgacgggaagacctacctctactggtacctgcagaagcccggccagcccccgcagctgctcatcagcgaggtgttcaaccggttctccggggtgcccgaccgcttcagcggctccgggagcggcaccgacttcaccctgaagatctcccgggtcgaggccgaggacgtgggcgtgtactactgcatgcagagcctgcagctccccctgacgttcgggggcgggaccaaggtcgagatcaag

SEQ ID NO: 12496 - RNA, 336 nt, synthetic construct
  misc_feature 1..336: note = derived and/or modified sequence opt1 from anti-influenza_Chain
  source 1..336: mol_type = other RNA
gacatcgtgatgacccagagccccctgtccctcccggtcacccccggcgagcccgccagcatctcctgccgcgccagccagtccctgctgcacagcaacgggtacaactacctcgactggtacctgcagaagcccggccagtccccgcagctgctcatccagctggggagcacgcgggcgtccggcgtgcccgaccgcttcagcgggtccggcagcggcaccgacttcaccctggagatctcccgggtggaggccgaggacgtcggggtgtactactgcatgcaggccctccagctgcccctggccttcggccaggggacccgcctcgagatcaag

SEQ ID NO: 12497 - RNA, 336 nt, synthetic construct
  misc_feature 1..336: note = derived and/or modified sequence opt1 from anti-influenza_Chain
  source 1..336: mol_type = other RNA
gacatcgtgatgacccagagccccctgtccctcccggtcagccccggcgagcccgcctccatcagctgccgctccagccagtccctgctgcacgggaacggctacaactacctcgactggtacctgcagaagcccgggcagagcccgcggctgctcatctacctgggctccaaccgcgccagcggggtgcccgaccggttctccggcagcggctccgggaccgacttcaccctgaagatcagccgcgtggaggcggaggacgtcggcgtgtactactgcatgcaggccctccagacgcccctgaccttcgggggcgggaccaaggtggagatcaag

SEQ ID NO: 12498 - RNA, 336 nt, synthetic construct
  misc_feature 1..336: note = derived and/or modified sequence opt1 from anti-influenza_Chain
  source 1..336: mol_type = other RNA
cagagcgtgctgacccagcccccgtccgtcagcggcgcccccgggcagcgcgtgaccatctcctgcacgggcagctccagcaacatcggggccggctacgacgtgcactggtaccagcagctccccgggaccgcgcccaagctgctgatctacgacaacaacaaccggccgtccggcgtccccgaccgcttcagcggctccaagagcggggcctccgccagcctcgccatcaccggcctgcaggccgaggacgaggcgcactactactgccagtcctacgacaacagcctgtccgggagcgtgttcggcgggggcacccagctcacggtgctgtcc

SEQ ID NO: 12499 - RNA, 336 nt, synthetic construct
  misc_feature 1..336: note = derived and/or modified sequence opt1 from anti-influenza_Chain
  source 1..336: mol_type = other RNA
cagagcgtgctgacccagcccccgtccgtcagcggcgcccccgggcagcgcgtgaccatctcctgcacgggcagctccagcaacatcgggtccgactacgacgtgcactggtacaagcagctccccggcaccgcccccaagctgctgatcttcgggaacagcaaccggccgtccggcgtccccgaccgcttcagcggctccaagagcgggacctccgcgagcctcgccatcaccggcctgcaggccgaggacgaggccgactactactgccagtcctacgacagctccctgagcgggttccacgtgttcggctccgggacgaaggtgaccgtcctc

SEQ ID NO: 12500 - RNA, 336 nt, synthetic construct
  misc_feature 1..336: note = derived and/or modified sequence opt1 from anti-influenza_Chain
  source 1..336: mol_type = other RNA
cagagcgtgctgacccagcccccgtccgtcagcgccgcccccggccagaaggtgaccatctcctgcagcgggtccagctccaacatcggcaacgactacgtgagctggtaccagcagctccccgggacggcgcccaagctgctgatctacgacaacaacaagcgcccgtccggcatccccgaccggttcagcgggtccaagagcggcacctccgccaccctcggcatcaccgggctgcagacgggcgacgaggccaactactactgcgccacctgggaccgccggcccaccgcctacgtcgtgttcgggggcgggaccaagctgacggtgctcggc

SEQ ID NO: 12501 - RNA, 336 nt, synthetic construct
  misc_feature 1..336: note = derived and/or modified sequence opt1 from anti-influenza_Chain
  source 1..336: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccacccgggccaccggcatccccgaccgcttcagcgggcggggctccggcaccgacttcacgctcaccatcagctccctggagccggaggacttcgccgtgtactactgccagaactacgggagccccttcctgttcaccttcggccccgggaccaaggtggacatcaagcgcacggtc

SEQ ID NO: 12502 - RNA, 336 nt, synthetic construct
  misc_feature 1..336: note = derived and/or modified sequence opt1 from anti-influenza_Chain
  source 1..336: mol_type = other RNA
gacatccagctgacccagagccccctctccccgcccgtgaccctgggccagcccgccagcatctcctgccgcagctcccagagcctgctctacacggacgggttcacctacctgtcctggtaccaccagcggcccggccagagcccgcgccggctgatctacaagatctccaaccgcgacagcggggtccccgaccggttctccggcagcgggtccggcaccgacttcaccctcaagatcagccgcgtggaggccgaggacgtgggcgtctactactgcatgcaggcgacgcactggcccctgaccttcggggagggcaccaaggtggagatcaag

SEQ ID NO: 12503 - RNA, 336 nt, synthetic construct
  misc_feature 1..336: note = derived and/or modified sequence opt1 from anti-influenza_Chain
  source 1..336: mol_type = other RNA
gacatcgagctgacccaggagcccagcgcctccggcaccccggggcagcgcgtgacgatcagctgctccggcgacaccagcaacatcgggtccaacaccgtcagctggttccagctcctgcccggcaccgcccccaagctgctcatcttcacggacaaccagcggccctccggggtgccgggccgcttcagcggctccaagagcgggacctccgcgagcctggccatctccggcctgcagagcgaggacgagaccgactactactgcgccgcctgggacgactccctcaacgggtgggtgttcggcgggggcaccaagctgacggtcctgggccag

SEQ ID NO: 12504 - RNA, 336 nt, synthetic construct
  misc_feature 1..336: note = derived and/or modified sequence opt1 from anti-influenza_Chain
  source 1..336: mol_type = other RNA
gacatcgtgctgacccagagcccctccgccagcggctccccggggcagagcgtcaccatctcctgcacgggcaccagctccgacgtcgggggctacgactacgtgagctggtaccagcagcaccccgggaaggcccccaagctcatgatctacgaggtgcgcaagcggccctccggcgtgccggaccgcttcagcggctccaagagcgggaacaccgcgtccctgaccgtgagcggcctgcaggccgaggacgaggcctactactactgcgcctcctacgccgggacgtacatccacctcttcggcgggggcaccaagctgaccgtcctgggccag

SEQ ID NO: 12505 - RNA, 336 nt, synthetic construct
  misc_feature 1..336: note = derived and/or modified sequence opt1 from anti-influenza_Chain
  source 1..336: mol_type = other RNA
caggagcagctgatggagagcggcgggggcctcgtgaagcccgggggctccctgaccctgacctgcacggtcagcgggctctccctgtacagcaacgagatcaactgggtgcgccaggccccgggcaacggcctggagtggatcggggccatcgcgggctccgggagcgccgactacgcctcctgggccaagagccggtccaccatcacccgcaacaccaacctcaacacggtgaccctgaagatgaccagcctgaccgccgcggacacggccacctacttctgcgcctccttctgggacctctggggccccgggaccctggtcaccgtgagctcc

SEQ ID NO: 12506 - RNA, 336 nt, synthetic construct
  misc_feature 1..336: note = derived and/or modified sequence opt1 from anti-influenza_Chain
  source 1..336: mol_type = other RNA
cagcagcagctgatggagagcggcgggggcctcgtgaagcccgggggctccctgaccctgacctgcacggtcagcgggctctccctgtacagcaacgagatcaactgggtgcgccaggccccgggcaacggcctggagtggatcggggccatcgcgggctccgggagcgccgactacgcctcctgggccaagagccggtccaccatcacccgcaacaccgacctcaacacggtgaccctgaagatgaccagcctgaccgccgcggacacggccacctacttctgcgcctccttctgggacctctggggccccgggaccctggtcaccgtgagctcc

SEQ ID NO: 12507 - RNA, 336 nt, synthetic construct
  misc_feature 1..336: note = derived and/or modified sequence opt1 from anti-influenza_Chain
  source 1..336: mol_type = other RNA
cagcagcagctggtggagagcggcgggggcctcgtcaagcccgggggctccctgaccctgacctgccgcgtgagcgggctctccctgttcagcaacgagatcaactgggtgcggcaggccccgggcaacggcctggagtggatcggggccatcggcgggggcgggtccgcggactacgccagctgggccaagtcccgcagcacgatcacccggaacaccaacctcaacaccgtcacgctgcgcatgacctccctgaccgccgccgacaccgcggcctacttctgcgccagcttctgggacctctggggccccggcacgctggtgaccgtgtccagc

SEQ ID NO: 12508 - RNA, 336 nt, synthetic construct
  misc_feature 1..336: note = derived and/or modified sequence opt1 from anti-influenza_Chain
  source 1..336: mol_type = other RNA
gaggtgcagctggtcgagagcggcgggggcctcgtgaagcccgggggctccctgcgcctgagctgcgccgcctccgggctcagcctgttctccaacgagatcaactgggtgcggcaggcgccgggcaagggcctggagtggatcggggccatcggcgggggcgggagcgccgactacgcctcctgggccaagagccgcttcaccatctcccgggacaacgcgaagaacagcctctacctgcagatgaactccctgcgcgccgaggacaccgccgtctacttctgcgccagcttctgggacctctggggccccggcacgctggtgaccgtgtccagc

SEQ ID NO: 12509 - RNA, 336 nt, synthetic construct
  misc_feature 1..336: note = derived and/or modified sequence opt1 from anti-influenza_Chain
  source 1..336: mol_type = other RNA
gacatcgtgatgacccagagccccctgtccctcccggtcacccccggcgagcccgccagcatctcctgccgcagctcccagagcctgctgcggtccaacgggtacaactacctcgactggtacctgcagaagcccggccagagcccgcagctgctcatctacctggggtccaaccgcgccagcggcgtgcccgaccggttctccgggagcggctccggcacggacttcaccctgaagatcagccgcgtggaggcggaggacgtcggggtgtactactgcatgcaggccctccagaccccctacaccttcggccaggggacgaagctggagatcaag

SEQ ID NO: 12510 - RNA, 339 nt, synthetic construct
  misc_feature 1..339: note = derived and/or modified sequence opt1 from anti-influenza_Chain
  source 1..339: mol_type = other RNA
gacatcgtgatgacccagagccccgacttcctgccggtctccctcggcgagcgcgccaccatcaactgcaagagctcccagcgggtgctgtacagctccaacaacaagaactacctggcctggtaccagctcaagcccgggcagccgcccaagctgatcatctactgggcgagcacgcgcgagtccggcgtgcccgaccggttcagcgggtccggcagcgggaccgagttcaccctgaccatctccagcctccaggccgaggacgtcgccgtgtactactgccagcagtactactcccgcccctacacgttcggccagggcaccaagctggagatcaag

SEQ ID NO: 12511 - RNA, 339 nt, synthetic construct
  misc_feature 1..339: note = derived and/or modified sequence opt1 from anti-influenza_Chain
  source 1..339: mol_type = other RNA
gacatcgtgatgacccagagccccgactccctggccgtcagcctcggcgagcgcgccaccatcaactgcaagtccagccagtccgtgctgtacagctccaacaacaagaactacctggcgtggtaccagcagaagccggggcagccgcccaagctcctgatctactgggccagcacgcgggagtccggcgtgcccgaccgcatcagcgggtccggcagcggggccgacttcaccctgaccatctccagcctccaggccgaggacgtcgccgtgtactactgccagcagtacttcgcgacgccccggaccttcggccagggcaccaaggtggagatcaag

SEQ ID NO: 12512 - RNA, 339 nt, synthetic construct
  misc_feature 1..339: note = derived and/or modified sequence opt1 from anti-influenza_Chain
  source 1..339: mol_type = other RNA
gacatcgtgatgacccagagccccgactccctggccgtcagcctcggcgagcgcgccaccatcaactgcaagtccagccagtccgtgctgtacagctccaacaacaagagccacctggcgtggtaccagcagaagccggggcagccgcccaagctcctgatctactgggcctccacgcgggagagcggcgtgcccgaccgcttctccgggagcggctccgggaccgacttcaccctgatcatcagctccctccaggccgaggacgtcgccgtgtactactgccagcagtactacttcagccccctgaccttcggcggcgggacgaaggtggagatcaag

SEQ ID NO: 12513 - RNA, 339 nt, synthetic construct
  misc_feature 1..339: note = derived and/or modified sequence opt1 from anti-influenza_Chain
  source 1..339: mol_type = other RNA
gacatcgtgatgacccagagccccgactccctggccgtcagcctcggcgagcgcgccaccatcaactgccggtccagccagtccatcttccacaacagcaacaacgagaactacctggcctggtaccagcagaagccggggcagccgcccaagctgctcatctactgggcctccacgcgcgagagcggcgtgcccgaccggttctccgggagcggctccgggaccgacttcaccctgaccatcagctccctgcaggccgaggacgtggccgtctacttctgccagcagtactacaacgcgcccctcacgttcggcggcgggaccaaggtggagatcaag

SEQ ID NO: 12514 - RNA, 339 nt, synthetic construct
  misc_feature 1..339: note = derived and/or modified sequence opt1 from anti-influenza_Chain
  source 1..339: mol_type = other RNA
gagatcgtgctgacccagagccccctctccctgccggtcacccccggcgagcccgccagcatctcctgccgcagctcccagagcctgctccactccaacgggtacaactacctggactggtacctgcagaagcccggccagagcccgcagctcctgatctacctggggtccaaccgggccagcggcgtgcccgaccgcttctccgggagcggctccggcacggacttcaccctcaagatcagccgggtggaggcggaggacgtcggggtgtactactgcatgcaggccctgcagacgcccctgaccttcggcgggggcaccaaggtggagatcaagcgc

SEQ ID NO: 12515 - RNA, 339 nt, synthetic construct
  misc_feature 1..339: note = derived and/or modified sequence opt1 from anti-influenza_Chain
  source 1..339: mol_type = other RNA
gacatcgtgctgacccagcccccgagcgtctccgtggcccccggccagaccgccacgatcacgtgcgggggcaactacatcgggagcaagtccgtgaactggtaccagcagcgccccggccacgcgcccgtcctcgtggtgtacgacgacagcgaccggccgtccgggatccccgaccgcttcagcggctccaacagccggtccaccgccaccaccgccaccctgaccatcagccgcgtcgaggccggcgacgaggccgactactactgccaggtgtgggagacctccgaggacctgtgggtgttcgggggcgggacgaagctcaccgtcctgggccag

SEQ ID NO: 12516 - RNA, 342 nt, synthetic construct
  misc_feature 1..342: note = derived and/or modified sequence opt1 from anti-influenza_Chain
  source 1..342: mol_type = other RNA
gacgtggtcatgacccagagccccgactccctggccgtgagcctcggcgagcgcgccaccatcaactgcaagtccagccagtccgtgctgtacagctccaacaacaagaactacctggcgtggtaccagcagaagccggggcagccgcccaagctcctgatctactgggccagcacgcgggagtccggcgtccccgaccgcttcagcgggtccggcagcgggaccgacttcaccctgaccatctccagcctccaggccgaggacgtggccgtgtactactgccagcagtactactccacgcccctgaccttcggcggcgggaccaaggtcgacatcaagcgg

SEQ ID NO: 12517 - RNA, 342 nt, synthetic construct
  misc_feature 1..342: note = derived and/or modified sequence opt1 from anti-influenza_Chain
  source 1..342: mol_type = other RNA
gacatccagatgacccagagccccgactccctggccgtgagcctcggcgagaaggccaccatcaactgcaagtccagccagtccatcctgaacagctccaacaacaagaactacctggcgtggtaccagcagaagcccgggcagccgcccaagctcctgatctactgggccagcacgcgcgagtccggcgtccccgaccggttcagcgggtccggcagcgggaccgacttcaccctgaccatctccagcctccaggccgaggacgtggccgtgtactactgccagcagtactactccagcccgcccacgttcggccagggcaccaaggtcgagatcaagcgc

SEQ ID NO: 12518 - RNA, 342 nt, synthetic construct
  misc_feature 1..342: note = derived and/or modified sequence opt1 from anti-influenza_Chain
  source 1..342: mol_type = other RNA
gagatcgtgctgacccagagccccgccaccctctccctgtacccgggcgagcgcgccacgctgagctgccgggcgtcccagagcgtctcccgctacctcgcctggtaccagcagaagcccgggcaggcgccccggctgctgatctacgacgccagcaaccgcgccaccggcatccccgcccggttctccgggagcggctccgggaccgacttcaccctcacgatcagctccctggagccggaggacttcgccgtgtactactgctgcgaccgccagcagcggagcaactggctgaagatcaccttcggccagggcacccgcctcgagatcaaggggaccgtg

SEQ ID NO: 12519 - RNA, 342 nt, synthetic construct
  misc_feature 1..342: note = derived and/or modified sequence opt1 from anti-influenza_Chain
  source 1..342: mol_type = other RNA
gacatcgtgatgacccagagccagaagttcgtctccaccagcgtgggcgaccgcgtgtccgtcacgtgcaaggccagccagaacgtggggtccaacgtggcctggtaccagcacaagcccggccacagcccgaccgcgctgatctactccgccagccaccggtactccggggtccccgaccgcttcaccggcagcgagtccgggaccgacttcacgctcaccatcagcaacgtgcagtccgaggacctggccgagtacttctgccagcagtactacagctacccctacaccttcggcggcgggaccaagctggagatcaagcgggccgacgccgcgcccacg

SEQ ID NO: 12520 - RNA, 342 nt, synthetic construct
  misc_feature 1..342: note = derived and/or modified sequence opt1 from anti-influenza_Chain
  source 1..342: mol_type = other RNA
gacatcgagatgacccagagccccctgtccctcccggtgacccccggcgagagcgcctccatcagctgccgctccagccagtccctgctgcacagcaacgggtacaactacctcgactggtacctgcagaagcccggccagagcccccagctgctcatctacctggggtcctcccgggccagcggcgtcccggaccgcttctccgggagcggctccggcacggacttcaccctgaagatcagccgggtggaggcggaggacgtgggggtctactactgcatgcagggcctccagaccccctacaccttcgggcagggcacgaagctggagatcaagcgcacc

SEQ ID NO: 12521 - RNA, 342 nt, synthetic construct
  misc_feature 1..342: note = derived and/or modified sequence opt1 from anti-influenza_Chain
  source 1..342: mol_type = other RNA
gacatcgagatgacccagagccccctgtccctcccggtgacccccggcgagcccgccagcatctcctgccgcagctcccagagcctgctgcactccaacgggtacaaccacctcgcctggtacctgcagaagcccggccggagcccgcacctcctgatctacctggcgtccacgcgcgccagcggggtccccgaccggttctccggcagcgggtccggcaccgacttcaccctgaagatcagccgcgtggaggccgaggacgtgggcatctactactgcatgcagtccctccagaccagcatcacgttcgggcagggcacccggctggagatcaagcgcacc

SEQ ID NO: 12522 - RNA, 345 nt, synthetic construct
  misc_feature 1..345: note = derived and/or modified sequence opt1 from anti-influenza_Chain
  source 1..345: mol_type = other RNA
caggtgcagctggtccagagcggcgccgaggtgaagaagcccgggtccagcgtgcgcgtctcctgcaagaccagcggcgggaccttctccagctacgccgtgacgtgggtgcggcaggcgccgggccaggggctcgagtggatgggcggcatcatcgggatgttcggcaccaccaactacgcccagaagttccaggggcgcctgaccatcacggccgacgagatgacctccaccgcctacatggagctgagctccctccggagcgaggacaccgccgtctactactgcgcgcgcggctcctactactacgagacgaccctggactactgggggcggggcaccctg

SEQ ID NO: 12523 - RNA, 345 nt, synthetic construct
  misc_feature 1..345: note = derived and/or modified sequence opt1 from anti-influenza_Chain
  source 1..345: mol_type = other RNA
gaggtgcagctggtccagagcggcgccgaggtgaagaagcccgggtccagcgtgaaggtctcctgcaagaccagcggcgggaccttctccagctacgccgtgacgtgggtgcgccaggcgccgggccaggggctcgagtggatgggcgccatcatcggcatgttcgggaccaccaactacgcccagaagttccagggccgggtcaccatcacggccgacgagctgacctccaccgcctacatggagctgagctccctccgcagcgacgacaccgcggtgtactactgcgcccgggggtcctactactacgagagctccctggactactggggcaaggggacgctg

SEQ ID NO: 12524 - RNA, 345 nt, synthetic construct
  misc_feature 1..345: note = derived and/or modified sequence opt1 from anti-influenza_Chain
  source 1..345: mol_type = other RNA
caggtgcagctggtccagagcggcgccgaggtgaagaagcccgggtccagcgtgaaggtctcctgcaagaccagcggcgggaccttctccagctacgccgtgacgtgggtgcgccaggcgccgggccaggggctcgagtggatgggcggcatcatcgggatgttcggcaccaccaactacgcccagaagttccaggggcgggtcaccatcacggccgacgagctgacctccaccgcctacatggagctgagctccctccgcagcgaggacaccgccgtgtactactgcgcgcggggctcctactactacgagagctccctggactactgggggcgcggcacgctg

SEQ ID NO: 12525 - RNA, 345 nt, synthetic construct
  misc_feature 1..345: note = derived and/or modified sequence opt1 from anti-influenza_Chain
  source 1..345: mol_type = other RNA
gaggtgcagctggtccagagcggcgccgaggtgaagaagcccggggcctccgtgaaggtcagctgcaaggcgtccggctacaccttcaccgggtactacgtgtactgggtgcgccaggccccgggccaggggctcgagtggatgggctggatcagcgcctacaacggcaacacgaactacgcccagaagttccaggggcgggtcaccatcaccgccgacaagtccaccagcacggcgtacatggagctgtccagcctgcgctccgaggacaccgccgtgtactactgcgcccggagccgctccctcgacgtgtggggccaggggaccaccgtcacggtgagctcc

SEQ ID NO: 12526 - RNA, 345 nt, synthetic construct
  misc_feature 1..345: note = derived and/or modified sequence opt1 from anti-influenza_Chain
  source 1..345: mol_type = other RNA
gacatcgtgatgacccagagccccctgtccctcccggtcacccccggcgagcccgccagcatctcctgccgcagctcccagagcctgctgcactccaacgggcacatctacttcgactggtacctccagaagcccggccagagcccgcagctgctgatctacctcgtgtccaagcgggccagcggggtgcccgaccgcttctccggcagcgggtccggcacggacttcaccctgaagatcagccgggtcgaggcggaggacgtgggcgtgtactactgcatgcaggccctggagacccccttcaccttcgggcccggcacgaaggtccacatcaagcgcaccgtg

SEQ ID NO: 12527 - RNA, 345 nt, synthetic construct
  misc_feature 1..345: note = derived and/or modified sequence opt1 from anti-influenza_Chain
  source 1..345: mol_type = other RNA
cagagcgccctgacccagcccgcctccgtgagcggctccccggggcagagcatcaccatctcctgcacgggcaccagctccgacgtcggggcgtacaactacgtgagctggtaccagcaccaccccggcaaggcccccaagctcatgatctacgacgtgacctaccgcccctccggggtcagcacccggttctccggcagcaagtccggcaacacggccagcctgaccatctccgggctgcaggccgaggacgaggccgactactactgcagctcccagagccgctccagcaccctcgtgatcttcggcgggggcaccaagctgacggtgctggggcagccgaag

SEQ ID NO: 12528 - RNA, 345 nt, synthetic construct
  misc_feature 1..345: note = derived and/or modified sequence opt1 from anti-influenza_Chain
  source 1..345: mol_type = other RNA
gacatcgtgctgacccagagccccgtctccctcgccgtgagcctgggcgagtccgccaccgtgaactgcaagagctcccagagcgtcctgtccaacagcaagaacctcaactacctggcgtggtaccagcacaagccggggcagccgcccaagctgctcatctactgggcctccacgcgcgagagcggcgtgcccgaccggttctccgggagcggctccgggaccgacttcaccctgaccatcagctccctgcaggccgaggacgtggccgtctactactgccagcagcactacagcatccccctcacgttcggccccggcaccaaggtggacatcaagcgcacc

SEQ ID NO: 12529 - RNA, 348 nt, synthetic construct
  misc_feature 1..348: note = derived and/or modified sequence opt1 from anti-influenza_Chain
  source 1..348: mol_type = other RNA
gacatcgtgctgacccagagccccctctccctgccggtcacccccggcgagcccgccagcatctcctgccgcagctcccagagcctgctcgactccaacgggtacaactacctggactggtacctgcagaagcccggccagagcccgcagctcctgatctacctggcctcctaccgggcgcccggggtgcccgaccgcttcagcggctccgggagcggcacggacttcaccctcaagatctcccgggtggaggccgaggacgtcggcctgtactactgcatgcaggccctgcagacgcccccgatgtacaccttcgggcagggcaccaagctcgagatcaagcgcacc

SEQ ID NO: 12530 - RNA, 351 nt, synthetic construct
  misc_feature 1..351: note = derived and/or modified sequence opt1 from anti-influenza_Chain
  source 1..351: mol_type = other RNA
ctggagagcggcgggggcctcgtgcagcccgggggctccctgcgcctgagctgcgccgcctccgggatcaccttcagctcctacgcgatgagctgggtccggcaggccccgggcaagggcctcgagtgggtgtccaccgtgaacagcgggggcgggtccacgtactacggcgacagcgtccgcgggcggttcaccatctcccgcgacaacagcaagtccaccctgtacctgcagctcaacagcctgcgggccgaggacaccgccatctactactgcgccaaggacaagggccgccccatcttcggcctggtgacgccctcctactacatggacgtgtgggggaacggcacc

SEQ ID NO: 12531 - RNA, 351 nt, synthetic construct
  misc_feature 1..351: note = derived and/or modified sequence opt1 from anti-influenza_Chain
  source 1..351: mol_type = other RNA
caggagcagctggtgcagagcggcgccgaggtcaagaagcccggggcctccgtgaaggtgagctgcaaggcgtcccgcaagagcttcatcggctactacgtccactgggtgcggcaggccccggggcagggcctcgagtggatggggtggatctcccccgacagcgacgccaccaagtacgcccagaagttccagggctccgtgatcatgacccgcgacacgagcgtctccaccgtgtacatggagctgagccggctgacctccgacgacaccgccctctactactgcctgctgttccgcggcgggaacagcctctcctggggccaggggacgctggtgaccgtcagctcc

SEQ ID NO: 12532 - RNA, 351 nt, synthetic construct
  misc_feature 1..351: note = derived and/or modified sequence opt1 from anti-influenza_Chain
  source 1..351: mol_type = other RNA
caggtgcagctgcaggagagcggccccgggctcgtcaagccgtccgagaccctgagcctgacctgcacggtgtccggcagctccatcagcaactactactggtcctggatccgccagagccccgggaagggcctcgagtggatcgggttcatctactacggcggcaacaccaagtacaacccctccctcaagagccgggtgaccatctcccaggacaccagcaagtcccaggtcagcctgacgatgtccagcgtgaccgccgccgagtccgcggtgtacttctgcgcccgcgccagctgctccgggggctactgcatcctggactactgggggcagggcaccctggtcacc

SEQ ID NO: 12533 - RNA, 351 nt, synthetic construct
  misc_feature 1..351: note = derived and/or modified sequence opt1 from anti-influenza_Chain
  source 1..351: mol_type = other RNA
gaggtgcagctggtcgagagcggcgggggcctcgtgcagcccgggggctccctgcgcctgagctgcgccgcctccgggttcaccttcagcatctacgcgatgtcctgggtgcggcaggccccgggcaagggcctcgagtgggtcagcgccatctccagctccggggacagcacctactacgccgactccgtgaagggccgcttcacgatcagccgggacaacgcccgcaacaccctgtacctgcagatgaactccctccgggcggaggacaccgccgtgtactactgcgcccgcgcctacgggtacaccttcgacccctggggccaggggacgctggtcaccgtgagctcc

SEQ ID NO: 12534 - RNA, 354 nt, synthetic construct
  misc_feature 1..354: note = derived and/or modified sequence opt1 from anti-influenza_Chain
  source 1..354: mol_type = other RNA
caggtgcagctgcaggagagcggccccgggctcgtcaagccgtccgagaccctgagcctgacctgcacggtgtccggctacagcttcgactccgggtactactggggctggctccgccagccgcccgggaagggcctggagtggatcggcagcatctaccactcccggaacacctactacaaccccagcctgaagtcccgcgtgaccatcagcgtcgacacctccaagaaccagttcagcctccagctgtccagcgtgacggccgccgacaccgcggtgtactactgcgcccgggggacctggtactccagcaacctgcgctactggttcgacccctggggcaaggggaccctc

SEQ ID NO: 12535 - RNA, 354 nt, synthetic construct
  misc_feature 1..354: note = derived and/or modified sequence opt1 from anti-influenza_Chain
  source 1..354: mol_type = other RNA
cagcccgtgctgacccagccgcccagcgcctccgccagcctcggcgcgtccgtcaccctgacgtgcaccctgagctccgcctacagcaactacaaggtggactggtaccagcagcgccccgggaagggcccccggttcgtgatgcgcgtcgggaccggcgggatcgtgggctccaagggcgacgggatcccggaccggttcagcgtgctcggctccgggctgaaccgctacctgaccatcaagaacatccaggaggaggacgagagcgactaccactgcggcgccgaccacgggtccggcagcaacttcgtctccccctacgtgttcggcgggggcacgaagctcaccgtgctg

SEQ ID NO: 12536 - RNA, 354 nt, synthetic construct
  misc_feature 1..354: note = derived and/or modified sequence opt1 from anti-influenza_Chain
  source 1..354: mol_type = other RNA
caggtgcagctggtccagagcggcgccgacgtgaagaagcccgggtccagcgtgaccgtctcctgcaaggccagcggcgggtccttcagcaactacggcatcaactgggtgcgccaggcgccggggcagggcctcgagtggatgggcgggatcatccccctgatcaacgcccccaactacgcccccaagttccagggccgggtgaccatcacggccgacatgttctccaacatcgtcagcctgcagctcacctccctgcgcaccgacgacaccgccgtgtactactgcgcgcggcgcaagatgacgaccgccatcgactactgggggcagggcaccctggtgaccgtcagctcc

SEQ ID NO: 12537 - RNA, 354 nt, synthetic construct
  misc_feature 1..354: note = derived and/or modified sequence opt1 from anti-influenza_Chain
  source 1..354: mol_type = other RNA
caggtgcagctggtccagagcggcgccgaggtgaagaagcccgggtccagcgtgaaggtctcctgccgcgagagcggcgggaccttcaacggctacaccatcacgtgggtgcggcaggccccggggcagggcctcgagtggatgggcgggatcatccccatgatgggcaccgtgaactacgcgcagaagctgcaggggcgcgtcaccatcaccacggactacttcaccaagaccgcctacatggacctgaacaacctccggtccgaggacaccgccatgtactactgcgtgaagatccgctacacgggccagcagctgctgtgggggcagggcaccctcgtgaccgtcagctcc

SEQ ID NO: 12538 - RNA, 354 nt, synthetic construct
  misc_feature 1..354: note = derived and/or modified sequence opt1 from anti-influenza_Chain
  source 1..354: mol_type = other RNA
caggtgcagctggtccagagcggcgccgaggtgaagaagcccggggcctccgtgaaggtcagctgcaaggcgtccggccacaccttcaccgggtactacatccactgggtgcgccaggccccgggccaggggctcgagtggatgggctggatcaaccccgacagcggcgccacgtccagcgcccagaacttccaggggcgggtgaccatgaccggcgacacctccagctccacggcctacatggagctgagccgcctgtccttcgacgacaccgcggtctactactgcgcccgggtcctcttcaccagccccttcgacttctggggcgaggggaccctggtgacggtgtccagc

SEQ ID NO: 12539 - RNA, 354 nt, synthetic construct
  misc_feature 1..354: note = derived and/or modified sequence opt1 from anti-influenza_Chain
  source 1..354: mol_type = other RNA
cagcccgtgctgagccagccgccctccgccagcgcctccctcggcgcgagcgtcaccctgacctgcacgctgtccagcgggttcgacaactaccaggtggcctggtaccagcagcgccccggcaaggggccccggttcgtgatgcgcgtcggcaacgggggcaacgtggcctccaagggcgacgggatcccggaccggttcagcgtgtccggcagcgggctcaaccgctacctgaccatcaagaacatccaggaggacgacgagtccgactactactgcggcgccgaccacgggagcggcaacaacttcgtctccccctacgtgttcggcgggggcaccaagctgaccgtgctc

SEQ ID NO: 12540 - RNA, 354 nt, synthetic construct
  misc_feature 1..354: note = derived and/or modified sequence opt1 from anti-influenza_Chain
  source 1..354: mol_type = other RNA
gaggtgcagctggtcgagagcggcgccgaggtgaagaagcccggggcctccgtgaaggtcagctgcaaggcgtccggctacaccttcagccgctactacatccactgggtgcggcaggccccggggcaggagctcgagtggatgggctggatcaaccccgactccggggacaccaactacgcccagaagttccgcggccgggtgacgatggcccgcgacaccagcatctccaccgtctacatggagctgaacagcctgcggtacgacgacaccgccgtgtacttctgcgcgcgcatcatctggtccagctccggcatggacgtgtgggggcagggcacgaccgtcaccgtgagc

SEQ ID NO: 12541 - RNA, 354 nt, synthetic construct
  misc_feature 1..354: note = derived and/or modified sequence opt1 from anti-influenza_Chain
  source 1..354: mol_type = other RNA
gaggtgcagctgctcgagagcggcgggggcgtcgtgcagcccgggcgctccctgcggctgagctgcgccgcctccggcttcaccttccgcacctacgggatgcactgggtgcggcaggcgccgggcaagggcctcgagtgggtcgccgtgatcagccacgacgggaacctgaagtactacggcgggtccgtgaagggccgcttcacgatcagccgggacaactccaagaacgccctgtacctccagatgaacagcctgcgcgtcgacgacaccgccctgtactactgcgcccgggggatcggcatcaccgacgcgttcgacatccgcggccaggggaccatggtggtggtctcc

SEQ ID NO: 12542 - RNA, 354 nt, synthetic construct
  misc_feature 1..354: note = derived and/or modified sequence opt1 from anti-influenza_Chain
  source 1..354: mol_type = other RNA
gaggtgcagctggtcgagagcggcgggggcctcgtgcagcccgggggctccctgcgcctgagctgcaccgcctccgggctcagcgtgtccagcacctacatgaactgggtccggcaggccccgggcaagggcctggagtgggtgtccgtgttctacagcgagacgcgcacctactacgcggactccgtcaaggggcggttcaccgtgagccgccacaactccaacaacaccctgtacctccagatgaacagcctgcgggtggaggacacggccgtctactactgcgcccgcgtgcagcggctgtcctacggcatggacgtgtgggggcagggcaccaccgtcaccgtgagctcc

SEQ ID NO: 12543 - RNA, 354 nt, synthetic construct
  misc_feature 1..354: note = derived and/or modified sequence opt1 from anti-influenza_Chain
  source 1..354: mol_type = other RNA
gaggtgcagctggtcgagagcggcgggggcctcgtgcagcccgggggctccctgcgcctgagctgcaccgcctccgggctcagcgtgtccagcacctacatgaactgggtccggcaggccccgggcaagggcctggagtgggtgtccgtgttctacagcgagacgcgcacctactacgcggactccgtcaaggggcggttcaccgtgagccgccacaactccaacaacaccctgtacctccagatgaacagcctgcgggccgaggacacggccgtgtactactgcgcccgcgtccagcggctgtcctacggcatggacgtgtgggggcagggcaccaccgtgaccgtcagctcc

SEQ ID NO: 12544 - RNA, 354 nt, synthetic construct
  misc_feature 1..354: note = derived and/or modified sequence opt1 from anti-influenza_Chain
  source 1..354: mol_type = other RNA
gacatgcagctggtggagagcggcgggggcctcgtcccgcccgggggctccctgcgcctgagctgcgccgcctccgggttcagcgtgtccgacaactacatcaactgggtgcggcaggcgcccggcaagggcctcgactgggtcagcgtgttctactccgccgaccgcaccagctacgccgactccgtgaaggggcggttcaccgtcagctcccacgacagcaagaacacggtgtacctgcagatgaactccctgcgcgccgaggacaccgccgtgtactactgcgcgcgggtccagaagtcctactacggcatggacgtgtgggggcagggcaccaccgtgacggtcagcagc

SEQ ID NO: 12545 - RNA, 357 nt, synthetic construct
  misc_feature 1..357: note = derived and/or modified sequence opt1 from anti-influenza_Chain
  source 1..357: mol_type = other RNA
gaggtgcagctggtcgagagcggccccgtgctcgtgaagccgaccgagaccctgacggtgacctgcaccgtctccgggttcagcgtggacaacgaccgcatgggcgtctcctggatccggcagccgcccgggaaggccctggagtggctcgcccacatcttcagcaacgacgagaagtcctacagcacctccctgcgcagccggctgacgatctccaaggacaccagcaagcgccaggtggtgctctccatgaccgacatggaccccgtcgacaccgcgacgtactactgcgcccgggcccccagcgagtacgccgccatggacgtgtggggccaggggaccatggtgaccgtctcc

SEQ ID NO: 12546 - RNA, 357 nt, synthetic construct
  misc_feature 1..357: note = derived and/or modified sequence opt1 from anti-influenza_Chain
  source 1..357: mol_type = other RNA
caggtgcaggtcgtgcagagcggcaccgaggtgaagaagcccgggtccagcgtcaaggtgtcctgccagaccagcggcgggcgcttcatgtcctacgccatcacgtgggtgcggcaggccccgggccaggggctggagtggatgggcggcatcgtccccgtgttcgggaccgcgaactacgcccagaagttccagggccgcgtgaccatcaccacggacgacagcacccggaccgcctacatggagctctccagcctgcgctccgaggacaccgccgtctactactgcgggttccggtacggcagcgggtacggcttcgactcctggggccaggggacgctggtgaccgtgagctcc

SEQ ID NO: 12547 - RNA, 357 nt, synthetic construct
  misc_feature 1..357: note = derived and/or modified sequence opt1 from anti-influenza_Chain
  source 1..357: mol_type = other RNA
gaggtgcagctggtcgagagcggcgccggggtgaagaagcccggctccagcgtgaaggtctcctgcaaggccagcgggaacaccttctccagcaacgcgatctcctgggtgcgccaggccccgggccaggggctcgagtggatgggcggcatcctggggatgctgcggaccacgaactacgcccagaagttccagggccgcgtgaccatcaccgccgacgagttcatgaacaccgcctacatggagctcagctccctgacgagcgaggacaccgcggtctactactgcgcccggtccagcgggtactaccccgactacttccacctgtggggccaggggaccctcgtgaccgtgtcc

SEQ ID NO: 12548 - RNA, 357 nt, synthetic construct
  misc_feature 1..357: note = derived and/or modified sequence opt1 from anti-influenza_Chain
  source 1..357: mol_type = other RNA
caggtgcagctgcaggagagcggccccgggctcgtcaagccgtccgagaccctgagcctgacctgcacggtgtccggcagctccatcagcaactactactggtcctggatccgccagagccccgggaagggcctcgagtggatcgggttcatctactacggcggcaacaccaagtacaacccctccctcaagagccgggtgaccatctcccaggacaccagcaagtcccaggtcagcctgacgatgtccagcgtgaccgccgccgagtccgcggtgtacttctgcgcccgcgccagctgctccgggggctactgcatcctggactactgggggcagggcaccctggtcaccgtgagc

SEQ ID NO: 12549 - RNA, 357 nt, synthetic construct
  misc_feature 1..357: note = derived and/or modified sequence opt1 from anti-influenza_Chain
  source 1..357: mol_type = other RNA
gaggtgcagctggtcgagagcggcgggggcctcgtgcagcccgggggctccctgcgcatcagctgcgccgcctccgggttcaccgtgagctccaactacatgagctgggtccggcaggcgccgggcaagggcctggagtgggtgtccgtgatctacagcgggggctccacctactacgccgacagcgtcaaggggcgcttctccttcagccgggacaactccaagaacacggtgttcctccagatgaacagcctgcgcgccgaggacaccgccgtgtactactgcgcccggtgcctgtcccgcatgcggggctacgggctcgacgtctggggccagggcaccaccgtgacggtgagc

SEQ ID NO: 12550 - RNA, 357 nt, synthetic construct
  misc_feature 1..357: note = derived and/or modified sequence opt1 from anti-influenza_Chain
  source 1..357: mol_type = other RNA
caggtgcagctgcaggagagcggccccgggctcgtcaagccctccgagaccctgagcctgacctgcacggtgtccggcgccagcatctccagcgactactggtcctggatccgcctcccgcccgggaagggcctggagtggatcgggtacatctacaaccggggcagcaccaagtacaccccctccctcaagagccgcgtgaccatctccctggacacggccgagaaccagttcagcctgcggctgcgctccgtcaccgcggccgacaccgccatctactactgcgcccggcacgtgggcgggcacacctacggcatcgactactgggggcagggcacgctcgtgaccgtcagctcc

SEQ ID NO: 12551 - RNA, 357 nt, synthetic construct
  misc_feature 1..357: note = derived and/or modified sequence opt1 from anti-influenza_Chain
  source 1..357: mol_type = other RNA
caggtgcagctgcaggagagcggccccgggctcgtcaagccctccgagaccctgagcctgacctgcacggtgtccggcgccagcatctccagcgactactggtcctggatccgcctcccgcccgggaagggcctggagtggatcgggtacatctacaaccggggcagcaccaagtacaccccctccctcaagagccgcgtgaccatctccctggacacggccgagaaccagttcagcctgcggctgcgctccgtcaccgcggccgacaccgccgtgtactactgcgcccggcacgtgggcgggcacacctacggcatcgactactgggggcagggcacgctcgtcaccgtgagctcc

SEQ ID NO: 12552 - RNA, 357 nt, synthetic construct
  misc_feature 1..357: note = derived and/or modified sequence opt1 from anti-influenza_Chain
  source 1..357: mol_type = other RNA
caggtgcagctgcaggagagcggcccccgcctcgtcaagccctccgagagcctgtccctgacctgcaccgtgagcgggggctccatcagcaactccttctgggggtggatccggcagccgcccggcgaggggctcgagtggatcggctacgtgtacaacagcggcaacacgaagtacaacccctccctcaagagccgcgtcaccatctcccgggacaccagcaagtcccagctgtacatgaagctgcgcagcgtgaccgccgccgacacggcggtgtactactgcgcccggcacgacgacgcctcccacgggtacagcatctcctggggccacgggaccctggtcaccgtgagctcc

SEQ ID NO: 12553 - RNA, 357 nt, synthetic construct
  misc_feature 1..357: note = derived and/or modified sequence opt1 from anti-influenza_Chain
  source 1..357: mol_type = other RNA
gaggtgcacctccagcagagcggccccgagctggtcaagccgggggcctccgtgaagatgagctgcgaggcctccggctacaccttcaccgactactacgtggcgtgggtcaagcagagccccggggagtccttcgagtggatcggccgcgtgaacccctacagcgggggcacgtcctacaaccagaagttcaagggcaaggccaccctgatcgtggacaagagctccagcaccgcctacatggagctgtccagcctcacctccgaggacagcgccgtctactactgcgcccggtgggactacggggtgtacgagggctacatcgactactgggggcagggctccgcgctgacggtg

SEQ ID NO: 12554 - RNA, 360 nt, synthetic construct
  misc_feature 1..360: note = derived and/or modified sequence opt1 from anti-influenza_Chain
  source 1..360: mol_type = other RNA
caggtgcagctggtccagcccggcgccgaggtgaagaagccggggagctccgtgaaggtcagctgcaaggcctccggcgggatcttcagcccctacgcgatctcctgggtgcgccaggcccccggccaggggctcgagtggatgggcggcatcatcgccatcttcgggaccaccaactacgcccagaagttccagggccgggtgacgatcaccgccgacaagagcaccaccacggcgtacctggagctgaactccctccgcttcgaggacaccgccgtctactactgcgcccgcgggggccggtactacgtggactacttcgactactgggggcagggcaccctggtgagcgtctccagc

SEQ ID NO: 12555 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggccccgacctcgtcaagccgggggcctccgtgaagatgagctgcaaggcctccggctacagcttcacctactaccacatgcactgggtgaagcagacccacgggaagtccctggagtggatcggccgcatcccctacaacgggggcacgaactacagccagcggttcaagggcaaggcggtcttcaccgtggacatgtccagctccaccgcctacatggagctgcgcagcctcacctccgaggacagcgccgtgtactactgcgcccgggacgccaactacgagggggactggtacttcgacgtctggggccaggggacgaccgtgaccgtgtccagc

SEQ ID NO: 12556 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccgaggtgaaggagcccgggtccgccatgaaggtgagctgcaaggcgtccggcgggaccttcagctccgacgccttctgctgggtccgccaggccccgggccgggggctcgagtggatgggcggcatcatccccgtgttccagaccgccaactacgggcccaacttccagggccgcgtgacgatcagcgccgacgtctacaccaccaccctgtacctggagctctccgggctgacgagcgaggacaccgcggtgtacttctgcgcccggtccggcgacgggtacaactactacttccccctgtggggccagggcaccctcgtgaccgtcagctcc

SEQ ID NO: 12557 - RNA, 360 nt, synthetic construct
  misc_feature 1..360: note = derived and/or modified sequence opt1 from anti-influenza_Chain
  source 1..360: mol_type = other RNA
cagatcaccctgcgcgagagcggccccaccctcgtgaagccgacgcagaccctgaccctgacctgcacgttctccgggttcagcctctccaccaacggcgtcaacgtggggtggatccggcagccgcccggcaaggccctggagtggctggccctcatctactgggacgacgacaagcgctacagcccctccctgaagcggcgcctgaccatcaccaaggacacgagcaagaaccaggtggtcctcaccctgaccaacatggaccccgtggacaccgcgacgtactactgcgcccaccggcccgacttctacggggacttcgagtactggggccccggcaccctggtgaccgtctccagc

SEQ ID NO: 12558 - RNA, 360 nt, synthetic construct
  misc_feature 1..360: note = derived and/or modified sequence opt1 from anti-influenza_Chain
  source 1..360: mol_type = other RNA
caggtgcagctggtccagagcggctccgaggtgaagaagcccgggaccagcgtgaaggtctcctgcaccgccagcggctccgtgttcacgaactacgggatcagctgggtgcgccaggccccgggccaggggctcgagtggatgggcggcatcatccccctgttcggggccgccaagtacgcccagaagttccagggccgggtcaccatcaccgccgacgagtccaccaagacggtgtacatggagctgagccgcctcacctccaaggacaccgccatctacttctgcgcgaaggcgccccgggtgtacgagtactacttcgaccagtgggggcagggcacccccgtcacggtgagctcc

SEQ ID NO: 12559 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccgacctcaagaagcccggggcctccgtgaaggtgagctgcaaggcgtccggctacaccttcaccgactactacatccactgggtccgccaggccccggggcagggcctggagtggatggggtggatcaaccccgagagcggcgacacgaagtacgcccagaagttccagggccgggtgaccatgacccgcgacacctccatcacgaccgcctacatggagctggggcggctccgcagcgacgacaccgccgtgtactactgcgcgcgggacgtctccaccacgtggagctggttcgccccctggggccaggggaccctggtgaccgtgtccagc

SEQ ID NO: 12560 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggccccgggctcgtcaagccgtccgagaccctgagcctgacctgctccgtgagcggcgggtccatcaactactactactggagctggatccgccagccgcccggcaaggggctcgagtgcatcggctacatctccgacacgggccggacctactacaaccccagcctgcgctcccgggtgaccatcagcgtcgacacctccaagaaccagttcagcctgaacctcacgtccatgaccgccgccgacaccgcggtgtactactgcgcccgcgaccccaccgggagccggcagaagaacgccttcgacatgtggggccaggggacgatggtgaccgtctcc

SEQ ID NO: 12561 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggcccccgcgtcgtgcggccgtccgagaccctcagcctgacctgcacggtgtccgggggcagcatctccagctacaactggatctggatccgccagccgcccgggaagggcctggagtggatcgggcacatctacgactacggccggaccttctacaactccagcctccagtcccgccccaccatcagcgtcgacgcctccaagaaccagctgagcctgcggctcacctccgtgacggccagcgacaccgcggtgtactactgcgcccgccccctgggcatcctgcactactacgccatggacctctgggggcagggcaccaccgtcacggtgtccagc

SEQ ID NO: 12562 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggccccgggctggtcaagccctccgagaccctgagcctgacctgctccgtgagcggcgggtccatcagctccgacttctggagctggatccgccagccgcccggcaaggggctcgagtggatcggctacgtgtacaaccggggctccacgaagtacagcccctccctcaagagccgcgtcaccatctccgccgacatgagcaagaaccagttctccctgaacatgagctccgtgaccgccgcggacaccgccgtgtactactgcgccaagaacgggcggagctccacgagctggggcatcgacgtctgggggaagggcaccaccgtgaccgtgagctcc

SEQ ID NO: 12563 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggccccgggctcgtcaagccgtccgagaccctgagcctgacctgcacggtgtccggcgggagcatctccgcctaccactggagctggatccgccagccgcccggcaaggggctcgagtggatcggccacatcttcgactccggcagcacctactacaacccctccctcaagagccgggtgaccatctccctggacgccagcaagaaccagctgtccctgcgcctgaccagcgtcacggcgtccgacaccgccatctactactgcgcccggcccctcgggagccgctactactacggcatggacgtgtgggggcagggcaccaccgtgacggtctccagc

SEQ ID NO: 12564 - RNA, 360 nt, synthetic construct
  misc_feature 1..360: note = derived and/or modified sequence opt1 from anti-influenza_Chain
  source 1..360: mol_type = other RNA
gaggtgcagctggtcgagagcggcgggggcctcgtgcagcccgggggctccctgcgcatcagctgcgccgcctccgggttcaccgtgagctccaactacatgagctgggtccggcaggcgccgggcaagggcctggagtgggtgtccgtgatctacagcgggggctccacctactacgccgacagcgtcaaggggcgcttctccttcagccgggacaactccaagaacacggtgttcctccagatgaacagcctgcgcgccgaggacaccgccgtgtactactgcgcccggtgcctgtcccgcatgcggggctacgggctcgacgtctggggccagggcaccaccgtgacggtgagctcc

SEQ ID NO: 12565 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggccccgggctcgtcaagccgtccgagaccctgagcctgacctgcacggtgtccggcagctccatcagcaactactactggtcctggatccgccagagccccgggaagggcctcgagtggatcgggttcatctactacggcggcaacaccaagtacaacccctccctcaagagccgggtgaccatctcccaggacaccagcaagtcccaggtcagcctgacgatgtccagcgtgaccgccgccgagtccgcggtgtacttctgcgcccgcgccagctgctccgggggctactgcatcctggactactgggggcagggcaccctggtcaccgtgagcagc

SEQ ID NO: 12566 - RNA, 360 nt, synthetic construct
  misc_feature 1..360: note = derived and/or modified sequence opt1 from anti-influenza_Chain
  source 1..360: mol_type = other RNA
caggtgcagctgcagcagagcggcgccgaggtcaagaagcccgggtccagcgtgaaggtgtcctgcaaggtcagcggcgtgatcttctccgggagcgccatctcctgggtgcgccaggcgccgggccaggggctcgagtggatgggcggcatcagccccctgttcgggaccaccaactacgcccagaagttccagggccgggtcacgatcaccgccgaccagtccaccaacaccacgtacatggaggtgaacagcctgcgctacgaggacaccgccgtgtacttctgcgcccgggggcccaagtactactccgagtacatggacgtctggggcaaggggaccaccgtgacggtgagctcc

SEQ ID NO: 12567 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatggggatgttcggcaccacgaactacgcccagaagttccaggggcgggtgaccatcaccgccgacgagttcaccagcgccgcgtacatggagctgcgctccctgcggagcgaggacacggccgtctactactgcgcccgctccagcggctactaccccgagtacttccaggactgggggcagggcaccctcgtgaccgtgtccagc

SEQ ID NO: 12568 - RNA, 360 nt, synthetic construct
  misc_feature 1..360: note = derived and/or modified sequence opt1 from anti-influenza_Chain
  source 1..360: mol_type = other RNA
cagatgcagctggtgcagagcggcgccgaggtcaagaagcccgggtccagcgtgaaggtgtcctgcaaggccagcggcgggaccttctccagctacgcgatcacctgggtccgccaggccccgggccaggggctcgagtggatgggcggcatcatcgggatgttcggctccacgaactacgcccagaacttccaggggcgggtgaccatcaccgccgacgagagcacctccacggcctacatggagctgagctccctgcgcagcgaggacaccgcggtgtactactgcgcccggtccaccggctactaccccgcctacctccaccactgggggcagggcaccctggtcacggtgagctcc

SEQ ID NO: 12569 - RNA, 360 nt, synthetic construct
  misc_feature 1..360: note = derived and/or modified sequence opt1 from anti-influenza_Chain
  source 1..360: mol_type = other RNA
gaggtgcagctggtcgagagcggcgccgaggtgaagaagcccgggtccagcgtgaaggtctcctgcaaggccagcggcgggaccttctccagctacggcatctcctgggtgcgccaggcgccggggcagggcctcgagtggatgggcgacatcatcgggatgttcggcagcaccaactacgcccagaacttccaggggcggctgacgatcaccgccgacgagtccaccagcaccgcctacatggagctgtccagcctccgctccgaggacacggccgtgtactactgcgcgcggagctccggctactaccccgcctacctgccccactgggggcagggcaccctggtcaccgtgagctcc

SEQ ID NO: 12570 - RNA, 360 nt, synthetic construct
  misc_feature 1..360: note = derived and/or modified sequence opt1 from anti-influenza_Chain
  source 1..360: mol_type = other RNA
gaggtgcagctggtcgagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatcgggatgttcggcaccgccaactacgcccagaagttccaggggcgggtgacgatcaccgccgacgagttcaccagcaccgcgtacatggagctgtccagcctgcgctccgaggacacggccgtctactactgcgcccggggcaactactactacgagagctccctcgactactgggggcagggcaccctggtgaccgtgagctcc

SEQ ID NO: 12571 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccgaggtgaagaagcccgggtccagcgtgaaggtctcctgcaaggccagcggcgggccgttccgcaacttcgcgatcaactgggtgcggcaggcccccggccaggggctcgagtggatgggcggcatcatcgccgtgttcgggaccaccaagtacgcccacaagttccagggccgcgtcacgatcaccgccgacgactccaccaacaccgcgtacatggagctggggagcctgaagtccgaggacacggccgtgtactactgcgcccggggcccccactactacagctcctacatggacgtgtggggcgaggggaccaccgtcaccgtgagctcc

SEQ ID NO: 12572 - RNA, 360 nt, synthetic construct
  misc_feature 1..360: note = derived and/or modified sequence opt1 from anti-influenza_Chain
  source 1..360: mol_type = other RNA
gaggtggccctggtcgagaccggcgccgaggtgaagaagcccgggagctccgtgaaggtcccgtgcaagagctccggcagccccttccgctccaacgcggtgagctgggtgcggcaggcccccgggcagggcctcgagtgggtcgggggcatcctgggcgtgttcgggtcccccagctacgcccagaagttccagggccgcgtgaccatcacggccgacgagtccaccaacaccgtccacatggagctgcgggggctccgcagcgaggacaccgccgtgtactactgcgcgcggggcccgacgtactactactcctacatggacgtgtgggggaagggcaccaccgtcaccgtgagctcc

SEQ ID NO: 12573 - RNA, 360 nt, synthetic construct
  misc_feature 1..360: note = derived and/or modified sequence opt1 from anti-influenza_Chain
  source 1..360: mol_type = other RNA
cagatgcagctggtgcagagcggcgccgaggtcaagaagcccgggtccagcgtgaaggtgtcctgcaaggccagcggcgggaccttctccagctacgcgatctcctgggtccgccaggccccgggccaggggctcgagtggatgggcggcatcttcgggatgttcggcaccgccaactacgcccagaagttccaggggcgggtgacgatcaccgccgacgagttcaccagcgcggcctacatggagctgtccagcctgggctccgaggacaccgccatgtactactgcgcccgcagctccgggtactacccccagtacttccaggactggggccagggcacgctcgtgaccgtcagctcc

SEQ ID NO: 12574 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccgaggtgaagaagcccgggtccagcgtgaaggtctcctgcaaggccagcggcgtgaccttctcctactacgcgatgagctgggtgcgccaggccccggggcagggcctcgagtggatgggcgggatctcccccatgttcggcaccacgacctacgcccagaagttccaggggcgggtcaccatcaccgccgacgacagcacgtccaccgcctacatggaggtgcgcagcctgcggtccgaggacaccgcggtgtactactgcgcccgcagctccaactactacgacagcgtctacgactactggggccaggggaccctggtgacggtgtccagc

SEQ ID NO: 12575 - RNA, 360 nt, synthetic construct
  misc_feature 1..360: note = derived and/or modified sequence opt1 from anti-influenza_Chain
  source 1..360: mol_type = other RNA
gaggtgcagctggtcgagaccggcgccgaggtgaagaagcccgggagctccgtgaaggtcccgtgcaagagctccggcagccccttccgctccaacgccgtgagctgggtgcggcaggcgcccgggcagggcctcgagtgggtcgggggcatcctgggcgtgttcgggtcccccagctacgcccagaagttccagggccgcgtgaccatcacggccgacgagtccaccaacaccgtccacatggagctgcgggggctccgcagcgaggacaccgccgtgtactactgcgcccggggcccgacgtactactactcctacatggacgtgtgggggaagggcaccaccgtcaccgtgagctcc

SEQ ID NO: 12576 - RNA, 360 nt, synthetic construct
  misc_feature 1..360: note = derived and/or modified sequence opt1 from anti-influenza_Chain
  source 1..360: mol_type = other RNA
caggtgcacctggtccagagcggcgccgaggtgcgcaagcccggggcctccgtgaaggtcagctgcaaggtgtccggctacaccctcaacgagctgagcatccactggctgcggcaggcgccggggcgcggcctcgagtggatggggtccttcgaccccgaggacggcgagaccatctacgcccagaagttccagggccgggtgacgatgaccggggacaccagcaccgacacggcctacctggagctgacctccctccgcagcgaggacaccgccctgtactactgcgcccggggctggggcgcggtcacctcccccttcgacttctgggggcaggggacgctggtgaccgtgagctcc

SEQ ID NO: 12577 - RNA, 360 nt, synthetic construct
  misc_feature 1..360: note = derived and/or modified sequence opt1 from anti-influenza_Chain
  source 1..360: mol_type = other RNA
gaggtgcagctggtccagagcggcgccgaggtgaagaagcccgggtccagcatgaaggtgtcctgcaaggccagcggctccatcttcagcaactacgggatctcctgggtccgccaggcgccgggccaggggctcgagtggatgggcggcatcatccccatcttcggggccgccaactacgcccagaagttccagggccgggtgaccatcaccgccgacgagagcacgtccaccgtgtacatggaggtccgcagcctgcggtccgaggacaccgcggtgtactactgcgcccgccggcagcagctgtacaaggggtactaccaccactggggccaggggaccctcgtgacggtcagctcc

SEQ ID NO: 12578 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccggggtgaagaagcccggctccagcatgaaggtgtcctgcaaggccagcgggtccatcttcagcaactacggcatctcctgggtccgccaggcgccggggcagggcctcgagtggatgggcgggatcatccccatcttcggcgccgccaactacgcccagaagttccaggggcgggtgaccatcaccgccgacgagagcacgtccaccgtgtacatggaggtccgcagcctgcggtccgaggacaccgcggtgtactactgcgcccgccggcagcagctgtacaagggctactaccaccactgggggcagggcaccctcgtgacggtcagctcc

SEQ ID NO: 12579 - RNA, 360 nt, synthetic construct
  misc_feature 1..360: note = derived and/or modified sequence opt1 from anti-influenza_Chain
  source 1..360: mol_type = other RNA
caggtgcagctgcaggagagcggccccgggctcgtcaagccgtccgagaccctgagcctgacctgcacggtgtccggcgggctcatcggcaccgggagctactactggggctggatccgccagacccccggcaaggggatggagtggatcggctccatcagctactccgggagcacctactaccacccctccctcaagagccgggtgacgatctccgacgacaccagcaagaaccagctgttcctgaagctgcgctccgtcaccgccgccgacaccgcgcagtactactgcgcccggtacaactggggcatccgctacttcgacttctgggggcggggcacgctggtgaccgtgagctcc

SEQ ID NO: 12580 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgccgaggtgcgcaagcccgggtccagcgtgaaggtctcctgcaaggtgagcggcgggatcatccggaagtacgccatcaactgggtgcgccaggcgccgggccaggggctcgagtggatgggcggcatcatcgccatcttcaacaccgccaactacgcccagaagttccaggggcgggtcaccatcacggccgacgagtccaccagcaccgtgtacatggagctgtccagcctgcgctccgaggacaccgcgctctactactgcgcccggggcatgaactactacagcgactacttcgactactgggggcagggctccctggtgacggtcagcccc

SEQ ID NO: 12581 - RNA, 360 nt, synthetic construct
  misc_feature 1..360: note = derived and/or modified sequence opt1 from anti-influenza_Chain
  source 1..360: mol_type = other RNA
caggtgcagctggtccagagcggcgggggcgtggtgcagcccgggcgctccctccggctgagctgcgccgcctccggcttcaccttccgcagccacgcgatgcactgggtccggcaggccccggggaagggccccgagtgggtggccctgatctcctacgacgaggtgaacaagttctacgccgacagcgtcaagggccgcttcaccatctcccgggacgtgagcaagaacacggtgttcctccagatgaactccctgagcgccgacgacaccgcggtctactactgcgcccgcgggcactccggcagctaccggctgttcgacttctgggggcagggcaccctcgtgaccgtgtccagc

SEQ ID NO: 12582 - RNA, 360 nt, synthetic construct
  misc_feature 1..360: note = derived and/or modified sequence opt1 from anti-influenza_Chain
  source 1..360: mol_type = other RNA
caggtgcagctggtcgagagcggcgggggcctcgtgcagcccgggggctccctgcgcctgagctgcgccgcctccgggttcatcttcggcgacttcgcgatccactgggtgcggcaggccagcggcaaggggctcgagtgggtcgcccgcatccggtccggcctgaaccgcttcgagaccgcctacgccgcgagcgtggaggggcggctgaccatctcccgcgacgacagcaagtccatggcctacctccagatgaacaacgtgaaggccgaggacacggccgtctacctgtgcacctacctggtgggcgcggtggggttccagcactggggccagggcaccctcgtcaccgtgagctcc

SEQ ID NO: 12583 - RNA, 360 nt, synthetic construct
  misc_feature 1..360: note = derived and/or modified sequence opt1 from anti-influenza_Chain
  source 1..360: mol_type = other RNA
caggtgcagctggtcgagagcggcgggggcgtggtgcagcccgggcgctccctccggctgagctgcgccgcctccggcttcaccttcagctcctacgggatctactgggtccgccaggcgccgggcaagggcctggagtgggtggccttcatcagctacgacgagatcaacaagttctacgccgactccgtgaaggggcggttcaccatcagccgcgacaactccaagaacacggtcttcctccagatgaacagcctgcgggacgaggacaccgccgtgtactactgcgccaagcccctgcgcggctcctaccggtacttcgacctctgggggcgcggcaccgtggtcaccgtgagctcc

SEQ ID NO: 12584 - RNA, 363 nt, synthetic construct
  misc_feature 1..363: note = derived and/or modified sequence opt1 from anti-influenza_Chain
  source 1..363: mol_type = other RNA
caggtgcagctgcaggagagcggccccgacctcgtcaagccgggggcctccgtgatgatcagctgcaaggcctccggctacagcttcacctactactacatgcactgggtgaagcagtcccacgggaagaccctggagtggatcggccgcatctacccctacaacggggacacgaactacaaccggcgcttcaaggacaaggcgatcctgaccgtcgacgagagctccagcaccgcctacatggagctccggtccctgaccagcgaggactccgccgtgtacttctgcgcccgcgacgccaactacgagggcgactggtacttcgacgtgtggggccaggggacgaccgtcaccgtgagctcc

SEQ ID NO: 12585 - RNA, 363 nt, synthetic construct
  misc_feature 1..363: note = derived and/or modified sequence opt1 from anti-influenza_Chain
  source 1..363: mol_type = other RNA
caggtgcagctggtccagagcggcgggggcgtggtgcagcccgggcgctccctccggctgagctgcgccgcctccggcttcaccttcagctcctacgcgatgcactgggtccgccaggccccggggaagggcctggagtgggtggccatcatcagctacgacggcaacgaccagtactacaccgactccgtgaaggggcggttcacgatcagccgcgactccagcaaggtctacctccagatgcaccggctgcgccccgaggacaccgccgtgtactactgcgccaaggagttcgagacctccggctacttccacgggagcttcgactactggggccaggggatcctggtgaccgtctccagc

SEQ ID NO: 12586 - RNA, 363 nt, synthetic construct
  misc_feature 1..363: note = derived and/or modified sequence opt1 from anti-influenza_Chain
  source 1..363: mol_type = other RNA
caggtgcaggtcgtgcagagcggcgccgaggtgaagaagcccgggtccagcgtccgcgtgtcctgccaggccagcggcgggaccttcatgaactacgcgatcatctgggtgcggcgcgccccgggccaggggctggagtggatgggcggcatcatccccgtcttccccacccccaactacgcccagatgttccaggggcgggtgacgatctccaccgacgagagccgctccaccagcttcctcgagctgaccaacctgcggtacgaggacacggccgtgtactactgcgcccgccggatctaccacggcgggaactccggcttcgacttctgggggcagggcaccctcgtcaccgtgagctcc

SEQ ID NO: 12587 - RNA, 363 nt, synthetic construct
  misc_feature 1..363: note = derived and/or modified sequence opt1 from anti-influenza_Chain
  source 1..363: mol_type = other RNA
caggtgcagctgcaggagagcggccccgggctcctgaagccctccgacaccctggccctgacctgcacggtcagcggcgggtccatcaccagcgactactggtcctggatccgccagccgcccggccgggggctggactggatcggcttcttctacaacggcgggagcaccaagtacaacccctccctcaagagccgcgtgaccatctccgccgacacgagcaagaaccagctctccctgaagctgaccagcgtgaccgcggccgacaccggcgtctactactgcgcccggcacgacgccaagttctccgggagctactacgtggcctcctggggccaggggacgcgcgtgaccgtcagctcc

SEQ ID NO: 12588 - RNA, 363 nt, synthetic construct
  misc_feature 1..363: note = derived and/or modified sequence opt1 from anti-influenza_Chain
  source 1..363: mol_type = other RNA
caggtgcagctgcaggagagcggccccgggctcctgaagccctccgacaccctggccctgacctgcacggtcagcggcgggtccatcaccagcgactactggtcctggatccgccagccgcccggccgggggctggactggatcggcttcttctacaacggcgggagcaccaagtacaacccctccctcaagagccgcgtgaccatctccgccgacacgagcaagaaccagctctccctgaagctgaccagcgtgaccgcggccgacaccggcgtctactactgcgcccggcacgacgtgaagttctccgggagctactacgtggcctcctggggccaggggacgcgcgtcaccgtgagctcc

SEQ ID NO: 12589 - RNA, 363 nt, synthetic construct
  misc_feature 1..363: note = derived and/or modified sequence opt1 from anti-influenza_Chain
  source 1..363: mol_type = other RNA
caggtgcagctgcaggagagcggccccgggctcgtcaagccctccgagaccctgagcgtgacctgcaaggtgtccggcgacagcatctccagctactcctggagctggatccgccagccgcccgggaagggcctggagtgggtcgggtacctctactactccggcagcacgaagtacaacccctccctcaagagccggaccaccatctccgtggacaccagcacgaaccagctgtccctgaagctgagcttcgtgaccgccgccgacaccgcggtctacttctgcgcccgcaccggctccgagagcacgaccgggtacggcatggacgtgtgggggcagggcaccaccgtgacggtctccagc

SEQ ID NO: 12590 - RNA, 363 nt, synthetic construct
  misc_feature 1..363: note = derived and/or modified sequence opt1 from anti-influenza_Chain
  source 1..363: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctcc

SEQ ID NO: 12591 - RNA, 363 nt, synthetic construct
  misc_feature 1..363: note = derived and/or modified sequence opt1 from anti-influenza_Chain
  source 1..363: mol_type = other RNA
caggtgcagctggtccagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctcc

SEQ ID NO: 12592 - RNA, 363 nt, synthetic construct
  misc_feature 1..363: note = derived and/or modified sequence opt1 from anti-influenza_Chain
  source 1..363: mol_type = other RNA
gaggtgcagctggtcgagaccggcgccgaggtgaagaagcccggggccagcgtgaaggtctcctgcaaggcgagcggctacaccttcacgtcctactacatgcactgggtgcgccaggccccggggcagggcctcgagtggatggggtggatcaaccccaacagcggcggcaccaactacgcccagaagttccaggggcgggtgaccatgacccgcgacacgtccatcagcaccgcctacatggagctgtcccggctgcgcagcgacgacaccgccgtctactactgcgcgcgggagggcaagtgggggccccaggccgccttcgacatctggggccaggggaccatggtgacggtgtccagc

SEQ ID NO: 12593 - RNA, 363 nt, synthetic construct
  misc_feature 1..363: note = derived and/or modified sequence opt1 from anti-influenza_Chain
  source 1..363: mol_type = other RNA
gaggtgcagctggtcgagagcggcgccgaggtgaagaagcccgggtccagcgtgaaggtctcctgcaaggccagcggcgggaccttctccttctacagcatgtcctgggtgcggcaggcgccgggccaggggctcgagtggatgggcggcatcatccccatgttcgggaccacgaactacgcccagaagttccagggccgggtgaccatcaccgccgtcgagagcacctccacggcctacatggaggtgagctccctgcgcagcgaggacaccgccgtgtactactgcgcgcgcggggacaagggcatctactactactacatggacgtctgggggaagggcaccaccgtgacggtgtccagc

SEQ ID NO: 12594 - RNA, 363 nt, synthetic construct
  misc_feature 1..363: note = derived and/or modified sequence opt1 from anti-influenza_Chain
  source 1..363: mol_type = other RNA
gaggtgcagctggtcgagaccggcgccgaggtgaagaagcccgggagctccgtgaaggtcagctgcaaggcctccggcgggaccttccgcacgcacgcgatcagctgggtgcggcaggccccgggccaggggctcgagtggatgggcggcatcatcgccatcttcgggaccgccaactacgcccagaagttccagggccgcatcaccatcaccgcggacgagtccacgagcaccgcctacatggagctgtccagcctgcggtccgaggacaccgccgtgtacttctgcgcccgcgggagcggctaccacatctccacccccttcgacaactgggggcagggcacgctcgtcaccgtgagctcc

SEQ ID NO: 12595 - RNA, 363 nt, synthetic construct
  misc_feature 1..363: note = derived and/or modified sequence opt1 from anti-influenza_Chain
  source 1..363: mol_type = other RNA
gaggtgcagctggtccagagcggcgccgaggtgaagaagcccgggtccagcgtgaaggtctcctgcaaggccagcggcgggatcttccgctccaacagcatctcctgggtgcggcaggcgccgggccaggggctcgagtggatgggcggcatcttcgccctgttcgggaccaccgactacgcccagaagttccagggccgcgtgacgatcaccgccgacgagagctccaccaccgtctacctggagctcagctccctgacgagcgaggacaccgccgtgtactactgcgcgcgggggtccggctacaccacccgcaactacttcgactactgggggcagggcacgctggtgaccgtcagctcc

SEQ ID NO: 12596 - RNA, 363 nt, synthetic construct
  misc_feature 1..363: note = derived and/or modified sequence opt1 from anti-influenza_Chain
  source 1..363: mol_type = other RNA
gaggtgcagctggtcgagagcggcgccgaggtgaagaagcccgggtccagcgtgaaggtctcctgcaaggccagcggcgggatcttcaactcctacgcgatcagctgggtgcgccaggccccgggccaggggctcgagtggatgggcggcatcatcgccatcttccacacccccaagtacgcccagaagttccaggggcgggtgaccatcacggccgacgagtccaccaacaccgcgtacatggagctgcgcagcctgaagtccgaggacaccgccctctactactgcgcccggggcagcacgtacgacttctccagcgggctggactactggggccaggggaccctggtcaccgtgtccagc

SEQ ID NO: 12597 - RNA, 363 nt, synthetic construct
  misc_feature 1..363: note = derived and/or modified sequence opt1 from anti-influenza_Chain
  source 1..363: mol_type = other RNA
caggtgcagctggtccagagcggcgccgaggtgaagaagcccgggtccagcgtgaaggtctcctgcaagagctccggcgggaacttcaacaactacgccgtgagctgggtgcgccaggcgccgggccaggggctcgagtggatgggcggcatctcccccatcttcgggagcaccaaccacgcccagaagttccagggccgggtcaccatctccgccgacatcttcacgaacaccgcctacatggagctgagctccctgcgcagcgacgacaccgccatctactactgcgcgcgggggcgcggctactacttctaccacgccatggacgtgtgggggcagggctccaccgtgacggtcagctcc

SEQ ID NO: 12598 - RNA, 363 nt, synthetic construct
  misc_feature 1..363: note = derived and/or modified sequence opt1 from anti-influenza_Chain
  source 1..363: mol_type = other RNA
caggtgcagctggtccagagcggcgccgaggtgaagaagcccgggtccagcgtgaaggtctcctgcaaggccagcggcgggaccttcaacaactacgcgatcaactgggtgcgccaggccccgggccaggggctcgagtggatgggcggcatctcccccatcttcgggagcgtgaactacgcccagaagctgcagggccgggtcaccatcacggccgacgtgttcacctccaccgcctacatggagctgagctccctccgcagcgaggacaccgcggtgtactactgcgccaaggggtccggctactactactactacgggctggacgtctggggcctgggcacgaccgtgaccgtgagctcc

SEQ ID NO: 12599 - RNA, 363 nt, synthetic construct
  misc_feature 1..363: note = derived and/or modified sequence opt1 from anti-influenza_Chain
  source 1..363: mol_type = other RNA
caggtgcagctggtcgagagcggcgggggcgtggtgcagcccgggcgctccctccggctgagctgcgccgcctccggcttcaccttcaccaactacgcgatgcactgggtccgccaggccccggggaagggcctggagtgggtggccgtgatcagcttcgacgaggacaacaagtcctacgccgactacgtcaagggccggttcacgatcagccgcgacaactccaacaaccggctctacctgcagatgaacagcctgcgcgccgaggacaccgcggtgtactactgcgcccgggggcccgagggcgtgtgggggcgctccatcgacagctggggccaggggaccctcgtcaccgtgtccagc

SEQ ID NO: 12600 - RNA, 363 nt, synthetic construct
  misc_feature 1..363: note = derived and/or modified sequence opt1 from anti-influenza_Chain
  source 1..363: mol_type = other RNA
caggtgcagctggtccagagcggcggggacctcgtgcagcccggcgggtccctgcgcctgagctgcgccgcctccggcttcaccttcagccggtactccatgaactgggtgcgccaggcgccggggatgggcctcgagtgggtcgcctacatcagcgacacctcccggacgatctactacgccgacagcgtgaagggccgcttcaccatctcccgggacaacgccaagaacagcctgtacctgcagatgaagtccctccgcgacgaggacaccgccgtgtactactgcgcgcgggaccccgacacccccttcgtccgcgccttcgacagctgggggcagggcacgctggtgaccgtgtccagc

SEQ ID NO: 12601 - RNA, 363 nt, synthetic construct
  misc_feature 1..363: note = derived and/or modified sequence opt1 from anti-influenza_Chain
  source 1..363: mol_type = other RNA
caggtgcagctggtcgagagcggcgggggcctcgtgcagcccgggggctccctgcgcctgagctgcgtggcctccgggttcaccttcagccggttctccatgaactgggtccgccaggccccgggcatgggcctcgagtgggtgagctacatctccgacaccgggcggacgatctactacgcggacagcgtgaagggccgcttcaccatctcccgggacaacgacaagaacaccctgtacctgcagatgaagtccctccgcgacgaggacagcgccttctactactgcgcccgggaccccgacacccccttcgtccgcgccttcgacagctgggggcagggcgtgctggtgacggtctccagc

SEQ ID NO: 12602 - RNA, 363 nt, synthetic construct
  misc_feature 1..363: note = derived and/or modified sequence opt1 from anti-influenza_Chain
  source 1..363: mol_type = other RNA
caggtgcagctgcaggagagcggccccgacctcgtcaagccgggggcctccgtgaagatgagctgcaaggcctccggctacagcttcacctactaccacatgcactgggtgaagcagacccacgggaagtccctggagtggatcggccgcatctacccctacaacgggggcacgaactacagccagcggttcaagggcaaggcggtcttcaccgtggacatgtccagctccaccgcctacatggagctgcgcagcctcacctccgaggacagcgccgtgtactactgcgcccgggacgccaactacgagggggactggtacttcgacgtctggggccaggggacgaccgtgaccgtgtccagc

SEQ ID NO: 12603 - RNA, 366 nt, synthetic construct
  misc_feature 1..366: note = derived and/or modified sequence opt1 from anti-influenza_Chain
  source 1..366: mol_type = other RNA
cagggccagctggtgcagagcggggccgaggtcaagaagtccggcagctccgtgaaggtgagctgcaagacctccgggggcaccttcaacagccacgccatctcctgggtccgccaggcgcccgggcagggcctcgagtggatcggcgggatcatcccgatgttcggcacgaccaactacgcccagaagctgaaggggcggatcgccatcaccgccgaccagctgcccaccacggcctacctcgagctgagctccctgcgcagcgaggacaccgcggtgtactactgcgcccggggccagcgctactactacgaccgggacgggatggacgtgtggggccagggcaccatggtcaccgtgtccagc

SEQ ID NO: 12604 - RNA, 366 nt, synthetic construct
  misc_feature 1..366: note = derived and/or modified sequence opt1 from anti-influenza_Chain
  source 1..366: mol_type = other RNA
caggtgcacctggtccagagcggcgccgaggtgaagaagcccgggtccagcgtgcgcctctcctgcagcgcctccggcgggccgttcagcggcttcgcgatctcctggctgcggcaggcccccgggcagggcctggagtggctcggcgggatcagcgccgtcttcggcaccgccacctacgcccagaagttccaggggcgcgtgacgatcaccgcggaccagttcacctccaccagccacatggacctgtcccggctgacgtacgacgacaccgccgtgtactactgcgcccgcagcggcgggtacctcccccagaacaactggatcgacccctggggccagggcaccctggtcatcgtgtccagc

SEQ ID NO: 12605 - RNA, 366 nt, synthetic construct
  misc_feature 1..366: note = derived and/or modified sequence opt1 from anti-influenza_Chain
  source 1..366: mol_type = other RNA
caggtgcagctggtccagagcggcgccgaggtgaagaaggccgggtccagcgtgaaggtctcctgccagagctccggcgtgaccttcagcatgtacgcggtgtcctgggtccgccaggcccccgggcagggcctcgagtggatgggcgggatcatcccgctgttcggcaccacgacctacgcccagaagttcgaggggcggctgaccatcaccgccgacacgagcaccaacatggcctacctcgagctgcgctccctgcggagcgaggacaccgcggtgtacttctgcgcccgcgccggcaccacggtgacccggttcaactggttcgacccctgggggcagggcaccctcgtcaccgtgtccagc

SEQ ID NO: 12606 - RNA, 366 nt, synthetic construct
  misc_feature 1..366: note = derived and/or modified sequence opt1 from anti-influenza_Chain
  source 1..366: mol_type = other RNA
caggtgcagctggtccagagcggcgccgaggtgaagaagcccgggtccagcctcaaggtgtcctgcaaggccagcggcgtcaccttctccatgtacaccatcagctgggtgcgccaggcgccggggcagggcctggagtggatgggcgggatcatccccctgttcggcacggccaactacgagcagaagttccaggggcgggtgaccatcaccgccgacacctccacgaacaccgcctacatggagctcagctccctgcgcagcgaggacaccgccgtctactactgcgcgcgggccggcaccacgctgacccgcttcaactggttcgacccctgggggcagggcaccctcgtgaccgtgtccagc

SEQ ID NO: 12607 - RNA, 366 nt, synthetic construct
  misc_feature 1..366: note = derived and/or modified sequence opt1 from anti-influenza_Chain
  source 1..366: mol_type = other RNA
atggccgacaacatgaccaccacgcagatcgagtggcgcatgaagaagatggccatcggcagctccacccacagctccagcgtgctgatgaaggacatccagtcccagttcgagcagctcaagctgcggtgggagagctaccccaacctggtcaagtccaccgactaccaccagaagcgcgagaccatccggctcgcgacggaggagctgtacctgctcagcaagcgcatcgacgactccatcctgttccacaagaccgtgatcgccaacagctccatcatcgccgacatgatcgtgagcctgtccctcctggagaccctgtacgagatgaaggacgtcgtggaggtgtacagccggcagtgcctc

SEQ ID NO: 12608 - RNA, 366 nt, synthetic construct
  misc_feature 1..366: note = derived and/or modified sequence opt1 from anti-influenza_Chain
  source 1..366: mol_type = other RNA
gaggtgcagctggtccagagcggcgggggcctcgtgcagcccgggggctccctgcgcctggcctgcgtggtcagcgggttcaccgtgacctccaactacatcacgtgggtgcggcaggccccgggcaagggcctcgagtgggtcagcgtgatctactcccacgggcgcgcgtactacagcgcctccgtgaacggccggttcaccatcagccgccacacctccaagaacaccgtctacctggagatgaacagcctgcggcccgaggacacggccgtgtactactgcgccgggggcgggctcgtgggcggctacgacgagtacttcttcgactactgggggcagggcaccctggccaccgtctccagc

SEQ ID NO: 12609 - RNA, 366 nt, synthetic construct
  misc_feature 1..366: note = derived and/or modified sequence opt1 from anti-influenza_Chain
  source 1..366: mol_type = other RNA
caggtgcagctggtccagagcggcgccgaggtgaagaagcccggggcctccgtgaaggtcagctgcaaggcgtccggctacaccttcaccgggtactacatgcactgggtgcgccaggccccgggccaggggctcgagtggatgggctggatcaaccccaacagcggcgacacgaactacgcccagaagttccaggggcgggtgaccatgacccgcgacacctccatcacgaccgcctacatggagctgagctccctgcggagcgacgacaccgccgtctactactgcgcgcgcgactccccctacagctccagctggtccttcttcgactactggggccaggggcccctcgtgaccgtgagctcc

SEQ ID NO: 12610 - RNA, 366 nt, synthetic construct
  misc_feature 1..366: note = derived and/or modified sequence opt1 from anti-influenza_Chain
  source 1..366: mol_type = other RNA
gaggtgcagctggtcgagagcggcgggggcctcgtgcagcccgggggctccctgcgcctgagctgcgccgcctccgggttcatcttccggaactactggatgagctgggtgcgccaggcgccgggcaagggcctcgagtgggtcgccaacatcaagcaggacgggcgggagaagtactacgtggactccctgcgcggccgggtgaacatcagccgcgacaacgccgagaactccctgtacctccacatgaacagcctgcgggtcgaggacaccgccgtgtacttctgcgcccgcgcgcggatggtggtcgtgaccggggacggcttcgacgtgtgggggcacggcacgatggtcaccgtgtccagc

SEQ ID NO: 12611 - RNA, 366 nt, synthetic construct
  misc_feature 1..366: note = derived and/or modified sequence opt1 from anti-influenza_Chain
  source 1..366: mol_type = other RNA
gaggtgcagctgctcgagagcggcgggggcctggtccagcccgggggctccctgcgcctcagctgcgccgcctccgggttcgcgttcagctcctacggcatgagctgggtgcggcaggcccccggcaaggggctggagtgggtgtccgccttcagcggctccgggaccagcacctactacgccgactccgtcaagggccgcttcacgatcagccgggacaagtccaagaacaccctgtacctccagatgaacagcctgcgcgccgaggacaccgcgatctactactgcgccaagccgcccgggccctacatcgtggtggccggcctgttcgagaactggggccgggggaccctcgtcacggtgtcc

SEQ ID NO: 12612 - RNA, 366 nt, synthetic construct
  misc_feature 1..366: note = derived and/or modified sequence opt1 from anti-influenza_Chain
  source 1..366: mol_type = other RNA
gaggtgcagctggtcgagagcggcgggggcgtggtgcagcccgggcgctccctccggctgagctgcgccgcctccggcttcagcttctccaactacgcgatgcactgggtccgccaggccccggggaagggcctggagtgggtggccctcatcagcttcgacggctccgacaagtactacgccgacagcgtgaaggggcggttcaccatgtcccgcgacaacagcaagaacaccctgtacctgcagatgaactccctccgggccgaggacacggcggtctactactgcgcccgcgacgagccctactgcggcggggactgcttcgccttcgacgtgtggggccaggggaccatggtgaccgtcagc

SEQ ID NO: 12613 - RNA, 366 nt, synthetic construct
  misc_feature 1..366: note = derived and/or modified sequence opt1 from anti-influenza_Chain
  source 1..366: mol_type = other RNA
caggtgcagctgcagcagagcggccccgggctcgtcaagccgtcccagaccctgagcctgacctgcacggtgtccggcgggcccgtgagcggcgggggctactcctggaactggatccgccagcggcccggccaggggctcgagtgggtcggcttcatgttccacagcgggagcccccgctacaacccgaccctgaagtcccggatcaccatctccgtggacaccagcaagaacctggtgtccctcaagctgagctccgtcacggccgccgacaccgcggtgtacttctgcgcccgcgtgggccagatggacaagtactacgccatggacgtctgggggcagggcaccaccgtgacggtgagctcc

SEQ ID NO: 12614 - RNA, 366 nt, synthetic construct
  misc_feature 1..366: note = derived and/or modified sequence opt1 from anti-influenza_Chain
  source 1..366: mol_type = other RNA
caggtgcagctggtccagagcggcgggggcctcgtgaagcccgggggctccctgcgcctgagctgcgccgcctccgggttcaccttcagctcctacagcatgaactgggtgcggcaggcgccgggcaagggcctcgagtgggtctccagcatctccagctccagctcctacatctactacgtggacagcgtgaaggggcgcttcaccatctcccgggacaacgccaagaacagcctgtacctgcagatgaactccctccgcgccgaggacacggccgtctactactgcgcccggggcgggggcagctacggggcgtacgagggcttcgactactggggccaggggaccctggtgaccgtgtccagc

SEQ ID NO: 12615 - RNA, 366 nt, synthetic construct
  misc_feature 1..366: note = derived and/or modified sequence opt1 from anti-influenza_Chain
  source 1..366: mol_type = other RNA
caggtgcagctggtccagagcggcgggggcgtggtgcagcccgggcgctccctccggctgagctgcgccgcctccggcttcaacttcagctcctacgggatgcactgggtccgccaggcgccgggcaagggcctggagtggctcagcgtgatctggtccgggggcagcaacaagtactacgccgactccgtgaaggggcggttcaccatcagccgcgacgactccaagaacaccgtctacctgcagatgaacagcctgcgggacgaggacacggccgtgtactactgcgcccgcgcccacaccgcgctcacccggttccgctggctggacccctggggccaggggatcctggtgaccgtctccagc

SEQ ID NO: 12616 - RNA, 366 nt, synthetic construct
  misc_feature 1..366: note = derived and/or modified sequence opt1 from anti-influenza_Chain
  source 1..366: mol_type = other RNA
caggtgcagctggtccagagcggcgggggcgtggtgcagcgcgggcggtccctccgcctgagctgcgccgcctccggcttcaccttccggacctacgggatgcactgggtccgccaggcgcccggcaagggcctggagtgcgtggccctcatcagctacgacgggacgaacaagtactacgccgactccgtgaagggccggttcaccatcagccgcgacaactccaaggacaccctgtacctgcagatgaacagcctccgggccgaggacaccggggtctactactgcgcctccctggactacgacttcagctactactaccaccgcgacgtgtggggcccggggacgaccgtgaccgtctccagc

SEQ ID NO: 12617 - RNA, 366 nt, synthetic construct
  misc_feature 1..366: note = derived and/or modified sequence opt1 from anti-influenza_Chain
  source 1..366: mol_type = other RNA
caggtgcagctggtcgagagcggcgggggcctcgtgcagcccgggggctccctgcgcctgagctgcgccgcctccgggttcaccttcagcgactactggatggtgtgggtccggcaggcgccgggcaagggcctcgtgtgggtgtcccgcatcagctccgacgggagcaccacgtcctacgccgacagcgtcaagggccccttcaccatctcccgggacaacgccaagaacaccctgtacctgcagatgaacagcctccgcgccgaggacaccgccgtgtactactgcgcgcgggtggccacgccctactactacgagtccgggttcgactactggggccagggggccctggtcaccgtgagctcc

SEQ ID NO: 12618 - RNA, 369 nt, synthetic construct
  misc_feature 1..369: note = derived and/or modified sequence opt1 from anti-influenza_Chain
  source 1..369: mol_type = other RNA
cagttccagctggtgcagagcggccccgaggtcaagaagccggggacctccgtgaaggtgagctgcaaggcctccggctacaccagcacgacctacgggatctcctgggtccgccaggtgcccggccaggggctcgagtggatgggctggatcaacccctacaacggcaacccccactacgggcagaagttccagggccgggtgaccctgacccgcgacacgagcaccaacaccgcctacctggagatcctctccctgcggagcgacgacaccgcggtctactactgcgcccgcgacgggtggggccagcagctggtgccgtactacttcgactactgggggcagggcacgctcgtgaccgtctccagc

SEQ ID NO: 12619 - RNA, 369 nt, synthetic construct
  misc_feature 1..369: note = derived and/or modified sequence opt1 from anti-influenza_Chain
  source 1..369: mol_type = other RNA
caggtgcagctggcccagagcggcgccgaggtcaagcgccccgggtccagcgtgaaggtgtcctgcaccgcgagcggcgggatcttccggaagaacgccatctcctgggtccgccaggccccgggccaggggctcgagtggatgggcggcatcatcgccgtgttcaacaccgccaactacgcgcagaagttccaggggcgggtgaagatcacggccgacgagagcggcaacaccgcctacatggagctgtccagcctgcgctccgacgacaccgccgtctactactgcgcgagccaccccaagtacttctacgggtccggcagctaccccgacttctgggggcagggcaccctcgtgacggtgtccagc

SEQ ID NO: 12620 - RNA, 369 nt, synthetic construct
  misc_feature 1..369: note = derived and/or modified sequence opt1 from anti-influenza_Chain
  source 1..369: mol_type = other RNA
caggtgcagctgcaggagagcggccccgggctcgtcaagccgtccgagaccctgagcctgacctgcacggtgtcccgcggcagcatcgggcactacttctggtcctggatccggcagccgcccggcaaggggctcgagtggatcggctacatcagctactccggcagcaccaagtacaacccctccctgcgcagccgggtgaccatctccgtcgacaccagcaagaaccagttctccctgaacctcaacagcgtgacggccaccgacaccgccctgtactactgcgcgcgcgaggactacgacatcctgaccggggccggccccgggatggaggtgtggggccaggggacgaccgtcaccgtgtccagc

SEQ ID NO: 12621 - RNA, 369 nt, synthetic construct
  misc_feature 1..369: note = derived and/or modified sequence opt1 from anti-influenza_Chain
  source 1..369: mol_type = other RNA
caggtgcagctgcaggagagcggccccgggctcgtcaagccgtccgagaccctgagcctgacctgcacggtgtccggcgccagcatcaactcccactactggagctggatccgccagccgcccgggaagggcctcgagtggatcgggtacgtgtactactccggcagcaccacctacaacccctccctcaagagccgggtcaccctgtccgtggacacgagcaagaaccagttctccctgaacctgagctccgtgaccgccgcggacaccgccttctactactgcgcccgccacccctacgacgtcctgaccggcagcggggactggttcgacccctggggccaggggacgctcgtgaccgtgtccagc

SEQ ID NO: 12622 - RNA, 369 nt, synthetic construct
  misc_feature 1..369: note = derived and/or modified sequence opt1 from anti-influenza_Chain
  source 1..369: mol_type = other RNA
caggtgcagctggtccagagcggcgccgaggtgaagcgccccgggtccagcgtgaaggtctcctgcaccgccagcggcgggatcttccggaagaacgcgatctcctgggtgcgccaggccccgggccaggggctcgagtggatgggcggcatcatcgccgtgttcaacaccgccaactacgcccagaagttccagaaccgggtcaagatcacggcggacgagagcgggaacaccgcctacatggagctgtccagcctgacctccgacgacaccgccgtgtactactgcgccagccaccccaagtacttctacggctccgggagctaccccgacttctggggccaggggacgctcgtgaccgtctccagc

SEQ ID NO: 12623 - RNA, 369 nt, synthetic construct
  misc_feature 1..369: note = derived and/or modified sequence opt1 from anti-influenza_Chain
  source 1..369: mol_type = other RNA
gaggtgcagctggtcgagagcggcgccgaggtgaagaagcccgggtccagcgtgaaggtctcctgcaaggccagcggcgggaccttccgctcctacgcggtgagctgggtgcggcaggccccgggccaggggctcgagtggatgggcggcatcatcgccatcttcgggaccacgaactacgcccagaagttccaggaccgcgtcaccatcaccgccgacgacctgccctccaccgcgtacatggagctgacgagcctccggtccgaggacaccgccgtgtacttctgcgtgcgcggccgggggtactacctgggcggggactacggcagcctggactcctggggccaggggaccctcgtcaccgtgagc

SEQ ID NO: 12624 - RNA, 369 nt, synthetic construct
  misc_feature 1..369: note = derived and/or modified sequence opt1 from anti-influenza_Chain
  source 1..369: mol_type = other RNA
gaggtgcagctggtcgagagcggcgggggcctcgtgcagcccgggcgctccctgcggctgagctgcgtgggctccgggttcaacttcgacggctacgccatgcagtgggtccgccaggtgccgggcaaggggctcgagtgggtgagcggcatctcctggcacagcgactccaccgggtacgccgacagcgtccggggccgcttcaccatctcccgggacaacgcgaagaacagcctgtacctgcagatggactccctccgccccgaggacacggccttctactactgcggcaagagcatcgggcacgtgggcgggtcctaccggcaccccatcgactactggggccaggggaccctggtgaccgtcagc

SEQ ID NO: 12625 - RNA, 369 nt, synthetic construct
  misc_feature 1..369: note = derived and/or modified sequence opt1 from anti-influenza_Chain
  source 1..369: mol_type = other RNA
caggtgcagctgcaggccagcggccccgggctcgtcaagccgtccgagaccctgagcctgacctgcacggtgtccggcgacagcatcacctccggggcctactactggacctggatccgccagcaccccggcaaggggctcgagtggatcggctacatctactacagcggcaacacctactacaacccctccctcaagagccgggtgacgatctccctggacaccagcaagaaccagttctccctgaaggtcaacagcgtgaccgcggccgacaccgccgtgtactactgcgcccgcgccgcgtccacgagcgtcctggggtacggcatggacgtgtgggggcagggcaccaccgtgaccgtctccagc

SEQ ID NO: 12626 - RNA, 369 nt, synthetic construct
  misc_feature 1..369: note = derived and/or modified sequence opt1 from anti-influenza_Chain
  source 1..369: mol_type = other RNA
caggtgcagctggtccagagcggcgccgaggtgaagaagcccgggtccagcgtgcgcgtctcctgcaaggccagcggctccatcttccggaactacgcgatgagctgggtgcgccaggccccggggcagggcctcgagtggatgggcgggatcatcgccatcttcggcacccccaagtacgcccagaagttccaggggcgggtgaccatcacggccgacgagtccaccagcaccgtctacatggagctgtccggcctgcgcagcgaggacaccgcgatgtactactgcgcccggatcccccactacaacttcgggtccggcagctacttcgactactgggggcagggcacgctcgtgaccgtgtccagc

SEQ ID NO: 12627 - RNA, 369 nt, synthetic construct
  misc_feature 1..369: note = derived and/or modified sequence opt1 from anti-influenza_Chain
  source 1..369: mol_type = other RNA
cagctgcagctccaggagagcggcccccgcctggtgaagccctccgagaccctgagcctgacctgctccgtcagcggggtgtccatcagctccagcaactactactggggctggatccggcagccgcccgggaagggcctggagtggatcgggacgatctaccactccggcagcacctactacaacccctccctcaagagccgcctcatcatctccgtggacaccagcaagaaccagttctacctgcagctgacctccctcacggccgccgacagcgcggtctactactgcgccaccggcgggggcttcgggtggtcccagacctacttcggctactgggggcagggcaccctggtgacggccagctcc

SEQ ID NO: 12628 - RNA, 369 nt, synthetic construct
  misc_feature 1..369: note = derived and/or modified sequence opt1 from anti-influenza_Chain
  source 1..369: mol_type = other RNA
gaggtgcagctgcagcagagcggccccgagctcgtcaagccgggggcctccgtgaagatgagctgcaaggcctccggctacaccttcaccagcttcatcatgtactgggtgaagcagaagcccgggcagggcctggagtggctggggtacatcgacccctacaacgacggcacgaagtacaacgagaagttcgagggcaaggcgaccctcacctccgacaagagctccagcaccgcctacatggagctgtccagcctgacgtccgaggacagcgccgtctactactgcgccaagcgcgggaactacggcaacgggttcgcctactggggccaggggaccctcgtgaccgtgtccgcggccaagaccagc

SEQ ID NO: 12629 - RNA, 369 nt, synthetic construct
  misc_feature 1..369: note = derived and/or modified sequence opt1 from anti-influenza_Chain
  source 1..369: mol_type = other RNA
caggtgcagctgctcgagagcggcggggacgtcgtgcagcccggcacctccctgcgcctgagctgcgccgcctccgggttcagcctctggacctccggcatgcactgggtgcggcaggcgccggggaagggcctggagtgggtcgccgtgatgagctacgacgagacgaagaagtactacgccgactccgtgcgcggccggttcagcatctcccgcgacaacagccggaacaccctgtacctccagatgaactccctgcgcgtcgaggacaccgccgtgtacttctgcgccaagccccggctggactacctcgactacttccacgcggccgacagctgggggcagggcaccctggtgtccgtcagctcc

SEQ ID NO: 12630 - RNA, 369 nt, synthetic construct
  misc_feature 1..369: note = derived and/or modified sequence opt1 from anti-influenza_Chain
  source 1..369: mol_type = other RNA
caggtgcagctggtcgagagcggcgccgaggtgcgcaagcccggggagtccctccggatcagctgcaaggcccacggcgactccttcaccagctactggatcgggtgggtgcgccagctgccgggcaaggggctggagtggatggcggtcatctacccccgggactccgagaccaagttcagccccgccttccacggccaggtgtccatcagcgtggacaagtccacgagcaccgtccacctccagtggaactccctgaaggccagcgacaccgccgtgtactactgcgcccgctcccccggctacagcgggtacctgtacggctggttcgacccgtgggggcagggcacccccgtgacggtctccagc

SEQ ID NO: 12631 - RNA, 369 nt, synthetic construct
  misc_feature 1..369: note = derived and/or modified sequence opt1 from anti-influenza_Chain
  source 1..369: mol_type = other RNA
caggtgcagctggtcgagagcggccccgggctcgtgaagccctccgagaccctgagcctgacctgcacggtgtccggcgacagcgtcatcaactccgcctactactgggactggatccgccagccgcccgggaagggcctcgagtgggtggggagcgtgtactactccggcatcacctactacaaccccagcctgaagtcccgggtcaccatcagcgtggacacctccaagaaccagttcagcctgcgcctctcctacgtgacggccgcggacaccgccctgtactactgcgcccggcgcggcgggggctggcagtactactacgggatggacgtctggggccaggggaccaccgtgacggtgagctcc

SEQ ID NO: 12632 - RNA, 369 nt, synthetic construct
  misc_feature 1..369: note = derived and/or modified sequence opt1 from anti-influenza_Chain
  source 1..369: mol_type = other RNA
caggtgcagctggtccagagcggcgccgaggtgaagaagcccggggcctccgtgaaggtcagctgcaaggcgtccggctacatcttcaccgggtactacatccactgggtgcgccaggccccgggccaggggctcgagtggatgggccggatcgaccccaacggcagcgggaccacgtacgcccagaagttccagggccgcgtgaccctgaccatggacacctccatcacgaccgcctacatggagctgagccggctccgcttcgacgacaccgccatctactactgcgcgcggtgggactggaacttcgacctgtacctggggtggttcgacccctggggccaggggacccccgtcacggtggcctcc

SEQ ID NO: 12633 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggcctccgtgaaggtcagctgcaaggcgtccggctacatcttcaccgggtactacatccactgggtgcgccaggccccgggccaggggctcgagtggatgggccggatcgaccccaacggcgccgggaccacgtacgcccagaagttccagggccgcgtgaccctgaccatggacaccagcatcacgaccgcctacatggagctgtcccggctccgcttcgacgacaccgcgatctactactgcgcccggtgggactggaacttcgacctgtacctggggtggttcgacccctggggccaggggacccccgtcacggtggccagc

SEQ ID NO: 12634 - RNA, 369 nt, synthetic construct
  misc_feature 1..369: note = derived and/or modified sequence opt1 from anti-influenza_Chain
  source 1..369: mol_type = other RNA
caggtgcagctggtccagagcggcgccgaggtgaagaagcccggggcctccgtgaaggtcagctgcaaggcgtccggctacaccttcaacgcccaccacatgcactgggtgcgccaggccccggggcagggcctcgggtggatgggctggatcgaccccaacaacgacggcaccatctacgcccagaagttccaggggcgggtgacgctgaccatggacaccagcatccacaccgcctacatggagctgtccggcctccgctacgacgacacggcgatctactactgcgtccggtgggcctggaacttcgacttcttcctggggtggttcgacccctggggccaggggaccctggtgaccgtggccagc

SEQ ID NO: 12635 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgacagcgacaccatctactcccccagcttccagggccaggtgacgatctccgccgacaacagcatctccaccgcgtacctgcagtggagctccctcaaggccagcgacaccgccatctactactgcgcctccgggcccgggtacagcggctaccactacgggtggttcgacacctggggccagggcacgctggtgaccgtctccagc

SEQ ID NO: 12636 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgacgccgacgcgatctacagcccctccttccagggccaggtgaccatcagcgccgacaactccatcagcacggcctacctgcagtggtccagcctcaaggcctccgacaccgccatctactactgcgcgagcgggcccgggtactccggctaccactacgggtggttcgacacctggggccagggcaccctggtgacggtcagctcc

SEQ ID NO: 12637 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgagagcgagaccatctactcccccagcttccagggccaggtgacgatctccgccgacaacagcatctccaccgcgtacctgcagtggagctccctcaaggccagcgacaccgccatctactactgcgcctccgggcccgggtacagcggctaccactacgggtggttcgacacctggggccagggcacgctggtgaccgtctccagc

SEQ ID NO: 12638 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgacgccgacaccatctacagcccctccttccagggccaggtgacgatcagcgcggacaactccatcagcaccgcctacctgcagtggtccagcctcaaggcctccgacaccgccatctactactgcgccagcgggcccgggtactccggctaccactacgggtggttcgacacctggggccagggcacgctggtgaccgtcagctcc

SEQ ID NO: 12639 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcagctccgacaccatctacagcccctccttccagggccaggtgacgatcagcgccgacaactccatcagcaccgcgtacctgcagtggtccagcctcaaggcctccgacaccgccatctactactgcgccagcgggcccgggtactccggctaccactacgggtggttcgacacctggggccagggcacgctggtgaccgtcagctcc

SEQ ID NO: 12640 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgacagcgacgccatctactcccccagcttccagggccaggtgaccatctccgcggacaacagcatctccacggcctacctgcagtggagctccctcaaggccagcgacaccgccatctactactgcgcctccgggcccgggtacagcggctaccactacgggtggttcgacacctggggccagggcaccctggtgacggtctccagc

SEQ ID NO: 12641 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgacaccgacacgatctacagcccctccttccagggccaggtgaccatcagcgccgacaactccatcagcaccgcgtacctgcagtggtccagcctcaaggcctccgacaccgccatctactactgcgccagcgggcccgggtactccggctaccactacgggtggttcgacacgtggggccagggcaccctggtgaccgtcagctcc

SEQ ID NO: 12642 - RNA, 369 nt, synthetic construct
  misc_feature 1..369: note = derived and/or modified sequence opt1 from anti-influenza_Chain
  source 1..369: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgccgggcaaggggctggagtggatcggcatgatgtaccccggcgagagcgacaccatctactcccccagcttccagggccaggtgacgatctccgccgacaacagcatctccaccgcgtacctgcagtggagctccctcaaggccagcgacaccgccatctactactgcgcctccgggcccgggtacagcggctaccactacgggtggttcgacacctggggccagggcacgctggtgaccgtctccagc

SEQ ID NO: 12643 - RNA, 372 nt, synthetic construct
  misc_feature 1..372: note = derived and/or modified sequence opt1 from anti-influenza_Chain
  source 1..372: mol_type = other RNA
caggtgcagctggtccagagcggcgccgaggtgaagaagcccgggtccagcgtgaaggtctcctgcaaggccagcggcgggatcttcatctcccaggcgatcagctgggtgcgccaggccccgggccaggggctcgagtggatgggcggcatcatccccatgttcggggccaccaactacgcccagaagttccagggccgggtgaccatcacggccgacaagtccaccaacaccgtctacatggagctgagctccctgaccagcgaggacacggcggtgtactactgcgcccgcctcgggtccggcagctaccacaacgggcccaactggttcgacccctggggccagggcaccctggtgaccgtctccagc

SEQ ID NO: 12644 - RNA, 372 nt, synthetic construct
  misc_feature 1..372: note = derived and/or modified sequence opt1 from anti-influenza_Chain
  source 1..372: mol_type = other RNA
caggtgcagctgcaggagagcggccccgggctcgtcaagccgtccgagaccctgagcctgaactgcgccgtgtccggcgggagcatctccaactactactggagctggatccgccagccgcccggcaaggggctcgagtggatcggctacatctcctacaacggccggcccaagtacaaccccagcctgacctcccgcgtgacgatcagcgtcgacacctccaaggaccagttcagcctggagctccggtccgtgaccgccgcggacaccgccctgtactactgcgcccgcgagacgcggttcggggagctgctcagcccctacgacgccttcgagatctggggccaggggaccatggtgaccgtctccagc

SEQ ID NO: 12645 - RNA, 372 nt, synthetic construct
  misc_feature 1..372: note = derived and/or modified sequence opt1 from anti-influenza_Chain
  source 1..372: mol_type = other RNA
caggtgcagctgcaggagagcggccccgggctcgtcaagccgtccgagaccctgagcctgacctgcacggtgtccggcgggagcgtgtccagcgagacctactactggtcctggatccggcagccgcccggcaaggggctcgagtggatcggctacatctactacatcggcaacaccgactaccggcccagcctgaagtcccgcgtcaccatcagcctggacacgtccaagaaccagttcagcctcaagctgtccagcgtgaccgccgccgacaccgcggtgtactactgcgcccgcggggcctactacgactccagcggctaccccgccttctacatctgggggcagggcaccatggtcacggtgtccagc

SEQ ID NO: 12646 - RNA, 372 nt, synthetic construct
  misc_feature 1..372: note = derived and/or modified sequence opt1 from anti-influenza_Chain
  source 1..372: mol_type = other RNA
caggtgcagctgcaggagagcggccccgggctcgtcaagccctccgagaccctgagcctgacctgcgccgtgtccggcgtgagcatctccaacatcgacttctactgggggtggatccgccagccgcccggcaaggggctcgagtggatcggcaacatctactacacgggcatcaccttctacaaccccagcctgtccagccgggtcgccatctccatcgacaccagcaagaaccagttctccctgaccctcacgagcgtgaccgcggccgacaccgccatgtactactgcgcccgccactacggggactccgaggccatcaacgacgcgttcgacatctggggccaggggaccatgctgacggtgagctcc

SEQ ID NO: 12647 - RNA, 372 nt, synthetic construct
  misc_feature 1..372: note = derived and/or modified sequence opt1 from anti-influenza_Chain
  source 1..372: mol_type = other RNA
caggtgcagctggtcgagagcggcgccgaggtgaagaagttcggggcctccgtgaaggtcagctgcaaggcgtccggctacaccctcatcgactactacatgcactgggtgcgcgtggcccccgggcagggcctggagtggatggggtggatcaacccgatcaacggcggcaccaactacgcccagaagttccaggggcgggtcacgatgacccgcgacaccagcatcaacaccgcctacatggacctgtccagcctccggtccgacgacacggccatgtactactgcacccgcggccggcccatcgggcgcaactgggagccccgggacaaggactactggggccaggggacccccgtgaccgtgagctcc

SEQ ID NO: 12648 - RNA, 372 nt, synthetic construct
  misc_feature 1..372: note = derived and/or modified sequence opt1 from anti-influenza_Chain
  source 1..372: mol_type = other RNA
caggtgcagctggtccagagcggcgccgaggtgaagaagcccgggtccagcgtgaccgtctcctgcaagaccagcggccacacgttcatctcctacgccatcagctggctccgccaggcgccggggcagggcctggagtggatgggcgggatcgtgcccatcttcggcaccgtgaactacacccagaagttccaggggcggctgaccatcacggccgacgagtccaccagcaccgcctacatggacctctcccgcctgaccttcgaggacacggccatctacttctgcgcccgggaggcgggctaccacagctccttcagcggggtctacttcgactactggggccaggggaccctgctcaccgtgtccagc

SEQ ID NO: 12649 - RNA, 372 nt, synthetic construct
  misc_feature 1..372: note = derived and/or modified sequence opt1 from anti-influenza_Chain
  source 1..372: mol_type = other RNA
gaggtgcagctgcagcagagcggccccgagctcgtcaagccgggggcctccgtgaagatcagctgcaaggcctccggctacaccttcaccgactacaacatgcactgggtgaagcagagcctggggaagtccctggagtggatcggctacatctaccccaacaacgggggcacgggctacaaccagaagttcgagagcaaggcgaccctcaccgtcgacaactccagctccaccgcctacatggagctgcgcacgctgaccagcgaggactccgccgtgtactactgcgtgcggagcggggcctactacttcaactacctcgtcccctacttcgactactggggccaggggaccaccctgacggtgtccagc

SEQ ID NO: 12650 - RNA, 372 nt, synthetic construct
  misc_feature 1..372: note = derived and/or modified sequence opt1 from anti-influenza_Chain
  source 1..372: mol_type = other RNA
gaggtgcagctgcagcagagcggccccgagctcgtcaagccgggggcctccgtgaagatcagctgcaaggcctccggctacaccttcaccgggtacaacatgcactgggtgaagcagagccacggcaagtccctggagtggatcgggaagatctaccccaacaacggcgtcacgggctacaaccaggagttccgcagcaaggcgaccctgaccgtggacaactccagctccaccgcctacatggagctccggagcctgacgtccgaggacagcgccatctacttctgcgtgcgctccggggcctactacgtcaactacctggtgccctacttcgactactggggccaggggaccaccctcaccgtgagctcc

SEQ ID NO: 12651 - RNA, 375 nt, synthetic construct
  misc_feature 1..375: note = derived and/or modified sequence opt1 from anti-influenza_Chain
  source 1..375: mol_type = other RNA
caggtgcagctggtccagagcggcgccgaggtgaagaagcccgggtccagcgtgaaggtctcctgcaaggccagcggcgtgacctccagcaactacccgatcacctgggtgcgccaggcgcccgggcagggcctcgagtggatgggcggggtcctgcccctgttcggcgtgacgaactacgcccagaagttccaggggcgggtgaccatctccgccgacaagagcaccaacaccgcctacatggagctctccagcctgcgctccgaggacacggccgtctactactgcgcgcggggcaagcgccccgggtactgcagcggcggggtgtgctccagcgactactggggccagggcaccctggtgaccgtctccagc

SEQ ID NO: 12652 - RNA, 375 nt, synthetic construct
  misc_feature 1..375: note = derived and/or modified sequence opt1 from anti-influenza_Chain
  source 1..375: mol_type = other RNA
caggtgcagctgcaggagagcggccccgggctcgtcaagccgtcccagaccctgagcctgacctgcacggtgtccggcgggagcatctccagcggcacctactactggtcctggatccgccaccaccccgggaagggcctcgagtggatcggctacatctaccacagcgggtccgcctactacaaccccagcctggagtcccgggtgaccatgagcgtcgacacctccaagaaccagttcagcctgaagctctccagcgtgacggccgcggacaccgccatctactactgcgcccgcgccgagaacctgctgtccccctacctcgccgagggcttcgacccgtgggggcagggcaccctggtgaccgtcagctcc

SEQ ID NO: 12653 - RNA, 375 nt, synthetic construct
  misc_feature 1..375: note = derived and/or modified sequence opt1 from anti-influenza_Chain
  source 1..375: mol_type = other RNA
gaggtgcagctggtccagagcggcgccgaggtgaagaagcccggggagtccctcaagatcagctgccaggcctccggctacagcttcacctcccggtggatcgggtgggtgcggcagatgccgggcaaggggctggagtgggtcggcttcatctaccccagcgactccgacgtgcgctacagcccctccttccggggccaggtgaccatcagcgcggacaagtccatcagcacggcctacctgcagtggtccagcctcaaggcctccgacaccgccatgtacttctgcgcccgcctcgggggcaacaaggactacggggactacctgtggtacttcgacctgtggggccgcggggcgctggtcaccgtgagctcc

SEQ ID NO: 12654 - RNA, 375 nt, synthetic construct
  misc_feature 1..375: note = derived and/or modified sequence opt1 from anti-influenza_Chain
  source 1..375: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatctggtacgacggggacaacaagtactacggcgacagcgtcaaggggcggttcaccatctcccgcgacaacagcaagaacaccctcttcctgcagatgaactccctgcgggccgaggacacggccgtgtactactgcgccaaggacaccgcggaccacggcgactacgtggacctcgggttcttcgacgcctggggccagggcaccctggtcacggtgagctcc

SEQ ID NO: 12655 - RNA, 375 nt, synthetic construct
  misc_feature 1..375: note = derived and/or modified sequence opt1 from anti-influenza_Chain
  source 1..375: mol_type = other RNA
gaggtgcagctggtccagagcggcgccgagctcaagatgcccggggagtccctgaagatcagctgcaaggcctccggctacaccttcaccaactactggatcgggtgggtgcgccagacgccgggcaaggggctggagtggatgggcatcatcttcccgcccgacagccagacctcctacagcccctccttccagggccaggtgaccttcagcgtcgacaactccatcagcgtggcgtacatccagtggtccagcctcaaggcctccgacaccgccatctactactgcgcccggagcgggatcttcgactggtccgcgcccctggtggaggccttcgacatctggggccaggggacggtcgtgaccgtgagctcc

SEQ ID NO: 12656 - RNA, 375 nt, synthetic construct
  misc_feature 1..375: note = derived and/or modified sequence opt1 from anti-influenza_Chain
  source 1..375: mol_type = other RNA
gaggtgcagctggtccagagcggcgccgaggtgaagaagcccggggagtccctcaagatcagctgcaagggctccgggtacagcttctccgactactggatcggctgggtgcgccagatgccgggggagggcctggagtggatgggcatcatctaccccgccagctccgagatccggtacagcccctccttccaggggctggtcaccatcagcgcggacaagtccatcaacaccgccagcctccagtggtccagcctgaaggcctccgacacggccatctactactgcgcccgccacgcgagctgctccgcccggagctgctactggggccccgtggactactgggggcagggcaccctggtgaccgtctccagc

SEQ ID NO: 12657 - RNA, 375 nt, synthetic construct
  misc_feature 1..375: note = derived and/or modified sequence opt1 from anti-influenza_Chain
  source 1..375: mol_type = other RNA
caggtgcagctggtcgagagcggcgggggcgtggtgcagcccgggcgctccctccggctgagctgcgccgcctccgagatcaccttcatcacctacgcgatgcactgggtccgccaggccccgggcaaggggctggagtgggtggccctcatcagcgacgacggctccaacaagttctacgccgacagcgtgaagggccggttcacgatctcccgcgacaacagcaagaacaccctgtacctgcagatgaactccctccgggccgaggacaccgcggcctactactgcgcccgcgagggggtctacttcgacagcggcacctaccgggggtacttcgactactggggccaggagacgctggtgaccgtgtccagc

SEQ ID NO: 12658 - RNA, 375 nt, synthetic construct
  misc_feature 1..375: note = derived and/or modified sequence opt1 from anti-influenza_Chain
  source 1..375: mol_type = other RNA
caggtgcagctgcaggagagcggccccgggctcgtcaagccgtcccagaccctgagcctgacctgcacggtgtccggcgggagcatctccagcggcaactactactggaactgggtgcgccagcaccccgggaagggcctcgagtggatcggctacatctactaccgggggtccaccttctacaaccccagcctgaagtcccgcgtcaccatcagcatcgacacctccaagaaccagttcagcctgcggctctccagcgtgacggccgccgacaccgcggtgtactactgcgccaaggacacccgctccagcctggacaactaccagtacggcatggacgtctgggggcagggcaccacggtgaccgtgtccagc

SEQ ID NO: 12659 - RNA, 375 nt, synthetic construct
  misc_feature 1..375: note = derived and/or modified sequence opt1 from anti-influenza_Chain
  source 1..375: mol_type = other RNA
gaggtgcagctgctcgagagcggcgggggcctggtccagcccgggggctccctgcgcctcagctgcgccgcctccgggttcagcttctccacctacgcgatgagctgggtgcggcaggccccgggcaagggcctggagtgggtgtccgggatcagcggctccggggagagcacctactacgccgactccgtcaagggccgcttcacggtgagccgggacaactccaagaacaccctgtacctccagatgaacagcctgcgcgccgaggacaccgccgtgtactactgcgcgaagcagggggaccacatcgcctggctgctccggggcatcaacttcgactactggggccagggggtcctggtgaccgtgtccagc

SEQ ID NO: 12660 - RNA, 375 nt, synthetic construct
  misc_feature 1..375: note = derived and/or modified sequence opt1 from anti-influenza_Chain
  source 1..375: mol_type = other RNA
caggtgcagctggtcgagagcggcgggggcgtggtgcagcccgggcgctccctccggctgagctgcgccgcctccggcttcgcgttccacaaccgcgccatgcactgggtccggcaggccccggggaagggcctggagtgggtggccctcatctacttcgacggcagcaagcagtactacgccgactccgtgaaggggcgcttcaccatcagccgggacaactccaagaacaccgtcttcctgcagatgaacagcctgcgccccgaggacacggcggtgtactactgcgccgtgcccggccccatcttcgggatcttcccgccctggtcctacttcgaccactggggccaggggatcctcgtcaccgtgagctcc

SEQ ID NO: 12661 - RNA, 375 nt, synthetic construct
  misc_feature 1..375: note = derived and/or modified sequence opt1 from anti-influenza_Chain
  source 1..375: mol_type = other RNA
gaggtgcagctggtcgagagcggcgggggcgtggtgcagcccgggcgctccctccggctgagctgcgccgcctccggcttcgcgttccacaaccgcgccatgcactgggtccggcaggccccggggaagggcctggagtgggtggccctcatctacttcgacggcagcaagcagtactacgccgactccgtgaaggggcgcttcaccatcagccgggacaactccaagaacaccgtcttcctgcagatgaacagcctgcgccccgaggacacggcggtgtactactgcgccgtgcccggccccatcttcgggatcttcccgccctggtcctacttcgaccactggggccaggggatcctcgtcaccgtgagctcc

SEQ ID NO: 12662 - RNA, 375 nt, synthetic construct
  misc_feature 1..375: note = derived and/or modified sequence opt1 from anti-influenza_Chain
  source 1..375: mol_type = other RNA
gaggtgcagctggtccagagcggcgggggcgtggtgcagcccgggaagtccctccgcctgagctgcgccgcctccggcctgaccttcagctcctacgcggtccactgggtgcggcaggccccggggaagggcctcgagtgggtgaccctgatcagctacgacggcgccaaccagtactacgccgactccgtcaaggggcgcttcacgatcagccgggacaactccaagaacaccgtgtacctgcagatgaacagcctccgccccgaggacaccgccgtgtactactgcgcggtccccggccccgtgttcgggatcttcccgccctggtcctacttcgacaactggggccaggggatcctggtgaccgtcagctcc

SEQ ID NO: 12663 - RNA, 375 nt, synthetic construct
  misc_feature 1..375: note = derived and/or modified sequence opt1 from anti-influenza_Chain
  source 1..375: mol_type = other RNA
caggtgcagctggtcgagagcggcgggggcgtggtgcagcccgggaagtccctccgcctgagctgcgccgcctccggcctgaccttcagctcctacgcggtccactgggtgcggcaggccccggggaagggcctcgagtgggtgaccctgatcagctacgacggcgccaaccagtactacgccgactccgtcaaggggcgcttcacgatcagccgggacaactccaagaacaccgtgtacctgcagatgaacagcctccgccccgaggacaccgccgtgtactactgcgcggtccccggccccgtgttcgggatcttcccgccctggtcctacttcgacaactggggccaggggatcctggtgaccgtcagctcc

SEQ ID NO: 12664 - RNA, 375 nt, synthetic construct
  misc_feature 1..375: note = derived and/or modified sequence opt1 from anti-influenza_Chain
  source 1..375: mol_type = other RNA
caggtgcagctggtcgagagcggcgggggcgtggtgcagcccgggaagtccccgcgcctcagctgcgccgcctccggccccaccttcagctcctacgcggtccactgggtgcggcaggcccccgggaagggcctggagtgggtgaccctgatcagctacgacggcgccaaccagtactacgccgactccgtcaaggggcgcttcacgatcagccgggacaactccaagaacaccgtgtacctccagatgaacagcctgcgccccgaggacaccgccgtgtactactgcgcggtccccggccccgtgttcgggatcttcccgccctggtcctacttcgacaactggggccaggggatcctggtgaccgtcagctcc

SEQ ID NO: 12665 - RNA, 375 nt, synthetic construct
  misc_feature 1..375: note = derived and/or modified sequence opt1 from anti-influenza_Chain
  source 1..375: mol_type = other RNA
gaggtgcagctggtcgagagcggcgggggcgtggtgcagcccgggaagtccctccgcctgagctgcgccgcctccggcctgaccttcagctcctacgcggtccactgggtgcggcaggccccggggaagggcctcgagtgggtgaccctgatcagctacgacggcgccaaccagtactacgccgactccgtcaaggggcgcttcacgatcagccgggacaactccaagaacaccgtgtacctgcagatgaacagcctccgccccgaggacaccgccgtgtactactgcgcggtccccggccccgtgttcgggatcttcccgccctggtcctacttcgacaactggggccaggggatcctggtgaccgtcagctcc

SEQ ID NO: 12666 - RNA, 375 nt, synthetic construct
  misc_feature 1..375: note = derived and/or modified sequence opt1 from anti-influenza_Chain
  source 1..375: mol_type = other RNA
caggtgcagctggtccagagcggcgccgagctcaagcgccccggggcctccgtgaaggtgagctgcaagacctccggctacagcttcaacaactacgggatcaactgggtccggcaggcgccgggccaggggctggagtggatgggctggatctccgcctacaccggcaacacgcactacgccaagaacttcgaggggcgcgtgaccctgaccaccgacacgagcacctccaccgcctacatggaggtgcggagcctccgctccgacgacagcgccgtctacttctgcgcgcgggccatgatccagggcgtggtgaccctgtacctgcgccccggggactactggggccaggggacgctcgtcaccgtgtccagc

SEQ ID NO: 12667 - RNA, 375 nt, synthetic construct
  misc_feature 1..375: note = derived and/or modified sequence opt1 from anti-influenza_Chain
  source 1..375: mol_type = other RNA
caggtgcagctggtccagagcggcgccgaggtgaagcagcccggggcctccgtgaaggtcagctgcaaggcgtccggctacaccttcaacgcctactacatccactgggtgcgccaggccccggggcagggcctcgagtggatggggtggatcaaccccaacttcggcggcacccactacgcccggaagttccaggggcgcgtgacgatgacccgggacgccagcatcaacaccgcgtacatggagctggaccgcctgatctccgacgacaccgccgtctactactgcgtgcggtggcgcgccgccgcggtgatcatggaccagttctacaagatggacgtctggggccaggggacgctcgtgaccgtgagctcc

SEQ ID NO: 12668 - RNA, 375 nt, synthetic construct
  misc_feature 1..375: note = derived and/or modified sequence opt1 from anti-influenza_Chain
  source 1..375: mol_type = other RNA
caggtgcagctggtccagagcggccccgagctcaagaagccggggtccagcgtgaagctgtcctgcatggccaccggcgggaccttcatcaactacgccttcagctgggtgcgccaggcgcccggccaggggctggagtggctcggcggcatcatccccgtctacgggacgtccaaccacgtggagaagctgcagggccgggtgaccatcaccgccgacgccagcaccaacacggcctacatggagctgtccgggctccgcttcgacgacaccgccgtctacttctgcgcggccagcaccgccacctccggcacgtactacgccatgcggcccttcgacttctgggggcagggcaccctggtgagcgtgtccagc

SEQ ID NO: 12669 - RNA, 378 nt, synthetic construct
  misc_feature 1..378: note = derived and/or modified sequence opt1 from anti-influenza_Chain
  source 1..378: mol_type = other RNA
gaggtgcagctggtcgagagcggcgggggcgtggtgcagcccgggggctccctccgcctgagctgcatcgcctccgccttcaacctggggatcttcggcatgcactgggtccggcaggcgccgggcaaggggctcgagtgggtggccttcatccgctacgacggcgggaagaccttctacgccgacagcgtgaagggccggttcaccatctcccgcgacaacagcaagaacacgctgtacctgcagatgaactccctccggaccgaggacaccgccctgtactactgcgcccgcgacgcgaccgccgactactacgggcccggcagctaccccaactggctggacccctggggccaggggacgctcgtcaccgtgtcc

SEQ ID NO: 12670 - RNA, 378 nt, synthetic construct
  misc_feature 1..378: note = derived and/or modified sequence opt1 from anti-influenza_Chain
  source 1..378: mol_type = other RNA
gaggtgcagctggtcgagagcggccccgccctcgtgaagcccacccagaccctgacgctgacctgctccttcagcgggttctccctcagcacctccggcatgagcgtgtcctggatccgccagccgcccgggaaggccctggagtggctggcgctcatcgactgggacgacgacacctactacatcacgtacagctccagcctgaagacccggctgaccatctccaaggacaccagcaagtcccaggtcgtgctcacgatgaccaacatggaccccgtggacaccgccacctactactgcgcccgcacgctgcgggtcagcggcgactacgtgcgcgacttcgacctgtgggggcggggcaccctcgtgaccgtctcc

SEQ ID NO: 12671 - RNA, 378 nt, synthetic construct
  misc_feature 1..378: note = derived and/or modified sequence opt1 from anti-influenza_Chain
  source 1..378: mol_type = other RNA
caggtgcagctgcaggagagcggccccgggctcgtcaagccgtccgagaccctgagcctgacctgcacggtgtccggcgggagcatcaactcctactactggaactggatccgccagccgcccggcaaggggctcgagtggatcggctacatctaccacagcggctccaccaactacaaccccagcctgaagtcccgggtgaccatcagcgtcgacacctccaagaaccagttcagcctgcagctctccagcgtgacggccgccgacaccgcggtgtactactgcgcccgcctgcggaccgactacggggaccccgactccgtctactactacggcatggacgtgtgggggcagggcaccacggtgaccgtcagctcc

SEQ ID NO: 12672 - RNA, 378 nt, synthetic construct
  misc_feature 1..378: note = derived and/or modified sequence opt1 from anti-influenza_Chain
  source 1..378: mol_type = other RNA
caggtgcacctggtccagagcggcgccgaggtgcgcaagcccggggactccgtgaaggtcagctgcaagacctccggctacaccttcagcacgtacccggtggcctgggtgcggcaggtccccgggcagggcctcgagtggatggggtggatctccacctacaacggcaacaccaacttcgcgcagaacttccagggccgcgtgaccctgacgaccgacaccaccacgaacaccgcctacatggaggtgcggagcctgaagttcgacgacaccgccgtctactactgcgcccgcgtggaggggtcctaccgggacttctggaacaaccagaaccgcttcgacccctggggccaggggaccctcgtgacggtcagctcc

SEQ ID NO: 12673 - RNA, 378 nt, synthetic construct
  misc_feature 1..378: note = derived and/or modified sequence opt1 from anti-influenza_Chain
  source 1..378: mol_type = other RNA
gaggtgcagctggtcgagagcggcgccgaggtgaagaagcccggggcctccgtgaaggtcagctgcaaggcgtccggctacaccttcaccagcttcgacatcaactgggtgcgccaggccccggggcagggcctcgagtggatggggtggatgacgcccacctccggcaagaccggctacgcccagaagttccaggggcggatcaccatgacgcgcaacaccagcatcaacaccgcctacatggagctgtccagcctgcggtccgaggacaccgccgtgtacttctgcgcgcgcggccccgagcggcgcacgaccatcttcgacgtcatcctcgactggttcgacccctgggggcagggcaccctggtgaccgtgagc

SEQ ID NO: 12674 - RNA, 378 nt, synthetic construct
  misc_feature 1..378: note = derived and/or modified sequence opt1 from anti-influenza_Chain
  source 1..378: mol_type = other RNA
caggtgcagctggtccagagcggcgccgaggtgaagaagcccgggtccagcgtgaaggtctcctgcaaggccagcggcgggttcttctccagctacgccatctcctgggtgcgccaggccccgggccaggggctcgagtggatgggcggcgtgatccccatcttccggaccgccaactacgcccagaacttccaggggcgcgtcaccatcacggccgacgagttcaccagctacatggagctgtccagcctgcggtccgacgacaccgcggtgtactactgcgcccgcctcaactaccacgacagcggcacctactacaacgcgccccgggggtggttcgacccctggggccaggggacgctggtgaccgtctccagc

SEQ ID NO: 12675 - RNA, 378 nt, synthetic construct
  misc_feature 1..378: note = derived and/or modified sequence opt1 from anti-influenza_Chain
  source 1..378: mol_type = other RNA
caggtgcagctggtccagagcggcgccgaggtgaagaagcccgggtccagcgtgaaggtctcctgcaaggccagcggcggggcgttctccaactacgccatcagctgggtgcgccaggccccgggccaggggctcgagtggatgggcggcatcatccccatcttcgggaccaccaactacgcccagaagttccagggccgggtgacgatcaccgccgacaagttcaccaccatcgcgtacatggagctgcgctccctgcggagcgaggacacggccgtctactactgcgcccgccacgggggcgtgtactactacgggtccgccagctccggctggttcgacccctggggccaggggaccctcgtgaccgtcagctcc

SEQ ID NO: 12676 - RNA, 378 nt, synthetic construct
  misc_feature 1..378: note = derived and/or modified sequence opt1 from anti-influenza_Chain
  source 1..378: mol_type = other RNA
caggtgcagctgctcgagagcggcgggggcgtcgtgcgccccgggcggtccctgcgcctggcctgcgccggcagcgggttcaccttctccgcgtacgccatgcactgggtgcggcaggccccgggcaagggcctcgagtgggtcgcccacaccagctacgacgggcgcgactcctactacgtggacagcgtgaagggccggttcacgatctcccgcgacgacagcaagaacaccctgtacctgcagatgaactccctccggcccgaggacaccgccgtctactactgcgcgaaggtggggccctacaccggctacgacgactacaactactacgggatggacgtgtggggccacggcacgaccgtcaccgtgagctcc

SEQ ID NO: 12677 - RNA, 378 nt, synthetic construct
  misc_feature 1..378: note = derived and/or modified sequence opt1 from anti-influenza_Chain
  source 1..378: mol_type = other RNA
caggtgcagctggtcgagagcggcgggggcgtggtgcagcccgggggctccctccgcctgagctgcgccgcctccgggttcaacttcgacgagtacgtcatgtactgggtgcggcagagcccgggcaagggcctggagtgggtgtccctcatcggggcggacggccgcgggacctacaacagcgactccgtcaagggccggttcaccatcagccgcgacaaccggaagaactccctgtacctgcagatgaacagcctccgctccgacgacacggccctgtactactgcgccaaggtggagcggagcttctacgacgggtccggctacggcgacgccctggagatctgggggcagggcaccatggtgaccgtcagctcc

SEQ ID NO: 12678 - RNA, 381 nt, synthetic construct
  misc_feature 1..381: note = derived and/or modified sequence opt1 from anti-influenza_Chain
  source 1..381: mol_type = other RNA
gaggtgcagctgctcgagagcggcgggggcctggtccaccccgggggctccctgcgcctcagctgcgccgcctccgggttcaccttcagcaactacgcgatgtcctgggtgcggcaggccccgggcaagggcctggagtgggtgagctccatcaacagcgggggcggggccacctactacgccgactccgtcaagggccgcttcacgatcagccgggacaactccaagaacaccctgagcctccagatgaactccctgcgcgccgaggacaccgcggtgtactactgcgccaaggagggcgggaacaccatcttcggcctggtgacgatggcctactacttcgacagctgggggcagggcaccctcgtcaccgtgtccagc

SEQ ID NO: 12679 - RNA, 381 nt, synthetic construct
  misc_feature 1..381: note = derived and/or modified sequence opt1 from anti-influenza_Chain
  source 1..381: mol_type = other RNA
cagccccagctgcaggagagcggcccggggctcgtgcgcccctccgagaccctgagcctgacctgcacggtctccggcgacagcgtgacccgcgggggcttctactgggggtggatccggcagccgcccggcaagggcctcgagtggatcgggtccatctactacaactacaacatctaccacagcccctccctcaagagccgggtgtccctgagcgtcgacacctccaagaaccaggtgagcctgaagctggcctccgtgaccgccgcggacacggccgtctactactgcgcccgccactacccctactacgacctgcccaccggcttctacagccagttcgacttctgggggcagggcacccccgtgaccgtgtccagc

SEQ ID NO: 12680 - RNA, 381 nt, synthetic construct
  misc_feature 1..381: note = derived and/or modified sequence opt1 from anti-influenza_Chain
  source 1..381: mol_type = other RNA
tggtggcagctggtgcagagcggcgccgaggtcaagaagcccgggtccagcgtgaaggtgtcctgcaaggccagcggcgggaccttctccagctacgacatctcctgggtccgccaggcgccgggccaggggctcgagtggatgggcggcatcatccccatctacgggaccgccaactacgcccagaagttccagggccgggtgacgatcaccgccgacgagagcacctccaccgcctacatggagctgagctccctgcgcagcgaggacacggcggtgtactactgcgcccgggccgggggcgactccagcgggtactacggcgccctcggccgcttcttccagcactgggggcagggcaccctggtcaccgtgtccagc

SEQ ID NO: 12681 - RNA, 381 nt, synthetic construct
  misc_feature 1..381: note = derived and/or modified sequence opt1 from anti-influenza_Chain
  source 1..381: mol_type = other RNA
gaggtgcagctggtccagagcggcggggccgtggtgcagcccggccgctccctccggctgagctgcgccgcgtccgggttcaccttcagcatctacgccatgcactgggtccgccagaccccgggcaaggggctggagtgggtggccctcatctcctacgacggcaacaacaagtactacgccgacagcgtgaagggccggttcacgatctcccgcgacaactacaagaacaccctgtacctgcagatgaaggggctccgggccgaggacaccgcgctgtactactgcgcccgccggatcaccgagaagggctactacaacgacagcgggcgccccaactggttcgacccctggggccaggggacgctggtcaccgtgtcc

SEQ ID NO: 12682 - RNA, 381 nt, synthetic construct
  misc_feature 1..381: note = derived and/or modified sequence opt1 from anti-influenza_Chain
  source 1..381: mol_type = other RNA
caggtgcagctgcagcagagcggcccccgcctcgtcaagccgtcccagaccctgagcctgacctgcgccatctccggggacagcgtgtccggcgacagcgggacgtggaactggatccggcagtcccccagccgcggcctcgagtggctggggcggacctactaccgctccaagtggtacaacgactacgccgagagcgtgaagtcccggatcgtcatcaaggcggacaccagcaagaacgagttctccctgcagctcaacagcgtgacccccgaggacacggccatctactactgcgcccgcgccggcgtgaagatcttcggcctgatcgtcggggccctggacaactggggccgggggaccctcgtgaccgtgtccagc

SEQ ID NO: 12683 - RNA, 381 nt, synthetic construct
  misc_feature 1..381: note = derived and/or modified sequence opt1 from anti-influenza_Chain
  source 1..381: mol_type = other RNA
caggtgcagctgcagcagtggggcgccgggctcctgaagcccagcgagaccctgtccctgacctgcacggtcagcggcgggtccctcaccgactacagctggaactggatccgccagccgcccggcaaggggctggagtggatcggcgacaccctccacaacggctacaccaactacaacccctccctgcgggggcgcgtgagcatctccatcgacacgagcaagaaccaggtgtccctgcggctcaccagcgtcaccgccgcggacaccgccctgtactactgcgcccgcggctccgggggctacgggggcttcgactacttcggcaagctgcggacgtgggacttctgggggcagggcaccctcgtgaccgtgagctcc

SEQ ID NO: 12684 - RNA, 381 nt, synthetic construct
  misc_feature 1..381: note = derived and/or modified sequence opt1 from anti-influenza_Chain
  source 1..381: mol_type = other RNA
caggtgcagctggtccagagcggcgccgaggtgcgcaagcccggggagtccctccggatcagctgccgcggctccgggtacaacttcccgaagtactggatcggctgggtgcggcagatgcccgggaagggcctggagtggatgggcatgatctaccccggggacagcgacgtccgctacaacccctccttccagggccaggtgaccatcagcgccgacgagtccatcaacaccgcgtacctgcagtggagctccctccggacgagcgacaccgcccgctactactgcgcccggcacctggggcagcagctggtgtccaacacctactactactacggcatggacgtctgggggcagggcaccacggtgaccgtgagctcc

SEQ ID NO: 12685 - RNA, 384 nt, synthetic construct
  misc_feature 1..384: note = derived and/or modified sequence opt1 from anti-influenza_Chain
  source 1..384: mol_type = other RNA
cagatccagctgcaggagagcggccccgggctcgtgaagccgtcccagaccctgagcctgacctgcgccatctccggcgacagcgtctccagcaacaacgccgtgtggaactggatccgccagtcccccagccgggggctcgagtggctgggccgcacgtactaccggtccaagtggtacaacgactacgcggagagcgtgaagtcccgcatcaccgtcaaccccgacaccagcaagaaccagttctccctgcacctcaagagcgtgacccccgaggacacggccgtgttctactgcgtccggtccgggcacatcaccgtgttcggcgtgaacgtcgacgccttcgacatgtggggccaggggaccatggtgaccgtgagctcc

SEQ ID NO: 12686 - RNA, 384 nt, synthetic construct
  misc_feature 1..384: note = derived and/or modified sequence opt1 from anti-influenza_Chain
  source 1..384: mol_type = other RNA
caggtgcagctgcaggagagcggccccgggctcgtcaagccgtcccagaccctgagcctgacctgcgccatctccggcgacagcgtgtccagcaacaacgccgtgtggaactggatccgccagtcccccagccgggggctcgagtggctgggccgcacgtactaccggtccaagtggtacaacgactacgcggagagcgtcaagtcccgcatcaccgtgaaccccgacaccagcaagaaccagttctccctgcacctcaagagcgtgacccccgaggacacggccgtcttctactgcgtgcggtccgggcacatcaccgtgttcggcgtcaacgtggacgccttcgacatgtggggccaggggaccatggtgaccgtcagctcc

SEQ ID NO: 12687 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgccatctccggcgaccgcgtgagctccaacagcgccgtgtggaactggatccggcagtcccccagccgcgggctcgagtggctgggccggacgtactaccgctccaagtggtactacgactacgcggagagcgtcaagtcccggatcgtgatcgaccccgacaccagcaagaaccaggtgtccctgcagctcaacagcgtcacccccgaggactccgccatctactactgcgcccgcgggggccacatcaccgtgttcggcctgaacatcgacgcctacgacatctgggggcagggcgccaaggtgacggtcagctcc

SEQ ID NO: 12688 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgccatctccggcgaccgcgtgagctccaacagcgccgtgtggaactggatccggcagtcccccagccgcgggctcgagtggctgggccggacgtactaccgctccaagtggtactacgactacgcggagagcgtcaagtcccggatcgtgatcgaccccgacaccagcaagaaccaggtgtccctgcagctcaacagcgtcacccccgaggactccgccatctactactgcgcccgcgggggccacatcaccgtgttcggcctgaacatcgacgcctacgacatctgggggcagggcgccatggtgacggtcagctcc

SEQ ID NO: 12689 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgccatctccggcgaccgcgtgagctccaacagcgccgtgtggaactggatccggcagtcccccagccgcgggctcgagtggctgggccggacgtactaccgctccaagtggtactacgactacgcggagagcgtcaagtcccggatcgtgatcgaccccgacaccagcaagaaccaggtgtccctgcagctcaacagcgtcacccccgaggactccgccatctactactgcgcccgcgggggccacatcaccgagttcggcctgaacatcgacgcctacgacatctgggggcagggcgccatggtgacggtgagctcc

SEQ ID NO: 12690 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgtgatctccggcgacacggtgagctccaaccgcgccacctggaactggatgcggcagagccccctccgcgggctggagtggctgggccggacctactaccgctccaagtggtacaacgactacgccgtcagcgtgaagtcccgggtggtcatcaaccccgacaccagcaagaaccaggtgtccctccagctgaacacggtgacccccgacgacagcggggtctacttctgcgcgcgcggcggccacatcaccgtgttcggggtgaacatcgacgccttcgacatctggggcctggggaccaaggtcacggtgtccagc

SEQ ID NO: 12691 - RNA, 384 nt, synthetic construct
  misc_feature 1..384: note = derived and/or modified sequence opt1 from anti-influenza_Chain
  source 1..384: mol_type = other RNA
caggtggagctgcagcagagcggccccgggctcgtcaagccgtcccagaccctgagcctgacctgcgccatctccggcgacagcgtgtccagcaactccgccacgtggaactggatccggcagagcccctcccgggggctcgagtggctgggccgcacctactaccggagcaagtggtacaacgactacgcggacttcctgaagcgccggatcaccatcaaccccgacacctccaacaacgaggtgagcctccgcctgacgtccgtcacccccgacgacaccgccctgtactactgcgcccgcgggggccacatcaccgtgttcggcgtgaacatcgacgccttcgacgtctgggggcagggcacgatggccaccgtgagctcc

SEQ ID NO: 12692 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgccatctccggcgacagcgtgtccagcaactccgccacgtggaactggatccggcagagcccctcccgggggctcgagtggctgggccgcacctactaccggagcaagtggtacaacgactacgcggacttcctgaagcgccggatcaccatcaaccccgacacctccaacaacgaggtgagcctccgcctgacgtccgtcacccccgacgacaccgccctgtactactgcgcccgcgggggccacatcaccgtgttcggcgtgaacatcgacgccttcgacgtctgggggcagggcacgatggtgaccgtgagctcc

SEQ ID NO: 12693 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgccatctccggcgacagcgtgtccagctacaacgccgtgtggaactggatccgccagtcccccagccgggggctcgagtggctgggccgcacgtactaccggtccgggtggtacaacgactacgcggagagcgtcaagtcccgcatcaccatcaaccccgacaccagcaagaaccagttctccctgcagctcaacagcgtgacccccgaggacacggccgtgtactactgcgcccggtccggccacatcaccgtcttcggcgtgaacgtggacgccttcgacatgtgggggcagggcaccatggtcaccgtgagctcc

SEQ ID NO: 12694 - RNA, 384 nt, synthetic construct
  misc_feature 1..384: note = derived and/or modified sequence opt1 from anti-influenza_Chain
  source 1..384: mol_type = other RNA
caggtgcagctgcagcagagcggccccgggctcgtcaagccgtcccagaccctgagcctgacctgcgccatctccggcgacagcgtgtccagcaacaacgccgtgtggaactggatccgccagtcccccagccgggggctcgagtggctgggccgcacgtactaccggtccaagtggtacaacgactacgcggagagcgtcaagtcccgcatcaccatcaaccccgacaccagcaagaaccagttctccctgcagctcaacagcgtgacccccgaggacacggccgtgtactactgcgcccggtccgggcacatcaccgtcttcggcgtgaacgtggacgccttcgacatgtggggccaggggaccaccgtcacggtgagctcc

SEQ ID NO: 12695 - RNA, 384 nt, synthetic construct
  misc_feature 1..384: note = derived and/or modified sequence opt1 from anti-influenza_Chain
  source 1..384: mol_type = other RNA
cgcggccagctggtgcagagcgggggcggggtcgtgcagcccggccggtccctccgcctgagctgcgccgcctccgggttcgtgttcaacgtcttcggcatccactgggtgcggcaggcgccgggcaaggggctggagtggctcgccaccatcagctacgacggcctgaacaagtactacgccgactccgtgaaggggcgcatcaccatcagccgggacaactccaagaacacgctgtacctccagatgaacagcctgcgcgccgaggacaccgccgtctactactgcgtgcgggactccgaggagagcacctactacggcgactacatgtgggtgtacaactggttcgacctgtgggggcagggcaccctcgtcacggtgtcc

SEQ ID NO: 12696 - RNA, 384 nt, synthetic construct
  misc_feature 1..384: note = derived and/or modified sequence opt1 from anti-influenza_Chain
  source 1..384: mol_type = other RNA
caggtgcagctgcagcagtggggcagcgggctcctgaagccctccgagaccctgagcctgacctgcgccgtctacggcgggtccttccgcgacgactactggacgtggatccggcagccgcccggcaaggggctggagtggatcggcgagatcaaccacagcggccgcaccaactacaacccctccctcaagagccgggtgaccatctccgtggacaccagcctcaagcagttctccctgaaggtcatcagcgtgacggccgcggacaccgccgtgtactactgcgcccgcgggacctcccacgtcagccggtacttcgactggctgcccccgaccaactggttcgacccctggggccaggggacccaggtgacggtgtccagc

SEQ ID NO: 12697 - RNA, 384 nt, synthetic construct
  misc_feature 1..384: note = derived and/or modified sequence opt1 from anti-influenza_Chain
  source 1..384: mol_type = other RNA
caggtgcagctgcagcagtggggcgccgggctcctgaagcccagcgagaccctgtccctcagctgcgccgtcttcggcgggtccttcagcgactactactggacctggatccgccagccgcccggcaaggggctggagtggatcggcgagatcaagcactccggccggacgaactacaaccccagcctggagtcccgcgtgaccatcagcgtggacacctccaagaaccagttcagcctcaagctgtccagcgtcaccgcggccgacacggccatctactactgcgcccgggggaccgaccccgacaccgagggctactgccgctccgggagctgctccgccttcgacttctggggccaggggaccctggtgacggtgagctcc

SEQ ID NO: 12698 - RNA, 384 nt, synthetic construct
  misc_feature 1..384: note = derived and/or modified sequence opt1 from anti-influenza_Chain
  source 1..384: mol_type = other RNA
caggtgcagctgcagcagtggggcgccgggctcctgaagcccagcgagaccctgtccctgacctgcggcgtctacgggggcagcctctccgactactactggagctggatccgccagccgcccgggaagggcctggagtggatcggcgagatcaaccactccgggggcacgaactacaaccccagcctcaagcggcgcgtgaccatctccgtggacaccagcaagaagcagttctccctgaagatgaacagcgtcaccgccgcggacacggccgtgtactactgcgcccgggggaccgaccccgacaccgaggtgtactgccgcgccggcaactgcgccgcgttcgacttctgggggcagggcaccctggtcacggtgtccagc

SEQ ID NO: 12699 - RNA, 384 nt, synthetic construct
  misc_feature 1..384: note = derived and/or modified sequence opt1 from anti-influenza_Chain
  source 1..384: mol_type = other RNA
caggtgcagctgcaggagagcggccccgggctcgtcaagccgtcccagaccctgagcctgacctgcacggtgtccggcgacagcatctccagcgtggaccactactggtcctggatccgccagcaccccgtcaaggggctcgagtggatcggcttcatgtactacagcgcctccacctactacaaccccagcctgaagtcccgggtgaccatcagcaccgacacgtccaagaaccagttcagcctgcgcctctccagcgtgaccgccgcggacaccgccgtctactactgcgcccgggggacctgcgccggcgactgctccctgcactactactactacggcctggacgtgtgggggcagggccgcacggtgaccgtcagctcc

SEQ ID NO: 12700 - RNA, 384 nt, synthetic construct
  misc_feature 1..384: note = derived and/or modified sequence opt1 from anti-influenza_Chain
  source 1..384: mol_type = other RNA
gaggtggccctggtcgagagcggcgccgaggtgaagaagcccgggtccagcgtgaaggtctcctgcaaggcgagcggccacatcttctccgggtacgccatcagctgggtgcgccaggccccgggccaggggctcgagtggatgggcggcatcatccccatcttcgggaccaccaactacgcccagaagttccagggccgggtgacgatcaccgccgaccagtccaccagcaccgcgtacatggacctgtccaacctgcgcagcgaggacacggccgtctactactgcgcccgggtgaaggacgggtactgcaccctcacctcctgccccgtgggctggtacttcgacctgtgggggcgcggcaccctggtcacggtgagctcc

SEQ ID NO: 12701 - RNA, 384 nt, synthetic construct
  misc_feature 1..384: note = derived and/or modified sequence opt1 from anti-influenza_Chain
  source 1..384: mol_type = other RNA
gaggtgcagctggtcgagagcggcgccgaggtgaagaagcccgggtccagcgtgaaggtctcctgcaaggccagcggccacatcttctccgggtacgcgatcagctgggtgcgccaggccccgggccaggggctcgagtggatgggcggcatcatccccatcttcgggaccaccaactacgcccagaagttccagggccgggtgacgatcaccgccgaccagtccaccagcaccgcctacatggacctgtccaacctgcgcagcgaggacacggcggtctactactgcgcccgggtgaaggacgggtactgcaccctcacctcctgccccgtgggctggtacttcgacctgtgggggcgcggcaccctggtcacggtgagctcc

SEQ ID NO: 12702 - RNA, 384 nt, synthetic construct
  misc_feature 1..384: note = derived and/or modified sequence opt1 from anti-influenza_Chain
  source 1..384: mol_type = other RNA
caggtgcagctggtccagagcggcgccgaggtgcgcaagcccggggcctccgtgaaggtcagctgcaaggcgtccggctacaccttcacccggcacgggatcagctgggtgcgccaggcccccggccaggggctcgagtggatgggctggatctccgcctacacgggcgacaccgactacgcccagaagttccaggggcgggtgaccatgaccacggacaccagcaccaacaccgcctacatggagctgcgctccctgcggagcgacgacgcggccgtctactactgcgcccgcctccggctgcagggcgaggtggtggtcccgccctcccagagcaactggttcgacccctgggggcagggcacgctggtgaccgtgtccagc

SEQ ID NO: 12703 - RNA, 384 nt, synthetic construct
  misc_feature 1..384: note = derived and/or modified sequence opt1 from anti-influenza_Chain
  source 1..384: mol_type = other RNA
caggtgcagctggtcgagagcggccccgggctcatgaagccgtccgagaccctgagcctgacctgcacggtgtccggcgggagcgtgtccaactactactggagctggatccgccagccgcccggcaaggggctcgagtggatcggctacgtcttctactccggcagctccaactacaaccccagcctgaacaacccctccctcaagagccgggtgaccatctccatcgacaccagcaacaaccagttctccctgaagctgagctccgtgaccgccgccgacacggcggtctactactgcgcccgcgggcgggtgaacagcggctacgactgggggcccaacttcgactcctggggccagggggccctggtgaccgtcagcagc

SEQ ID NO: 12704 - RNA, 384 nt, synthetic construct
  misc_feature 1..384: note = derived and/or modified sequence opt1 from anti-influenza_Chain
  source 1..384: mol_type = other RNA
caggtgcagctggtccagagcggcgccgaggtgaagaagcccgggtccagcgtgaaggtctcctgcaaggccagcggcgggaccttctcctactacgcgatcagctgggtgcgccaggccccgggccaggggctcgagtggatgggcggcatcatccccatcgtggggaccgcccactacacgcagaagttccagggccgggtcaccatcaccgccgacgagtccaccagcacggcctacatggagctgtccagcctgcgctccgaggacaccgcggtgtacttctgcgcccgggccgccgacgagagcgtggagtccctcaccatcaaggcgttccgcaccaactaccactgggggcagggcacgctggtcaccgtgagctcc

SEQ ID NO: 12705 - RNA, 387 nt, synthetic construct
  misc_feature 1..387: note = derived and/or modified sequence opt1 from anti-influenza_Chain
  source 1..387: mol_type = other RNA
gaggtgcagctggtcgagagcggcgggggcgccgtgcagcccggggagtccctcaagctgccgtgcgccgcgagcggcttcaccttctccaactacgggatgcactgggtgcgccaggcccccggcaagggcctggagtgggtcgccgtgatcagctacgacgggtccaacaagtactacgccgacagcgtgaagggccggttcaccatctcccgcgacaacagcaaggacacgctctacctgcagatgaactccctgcgggccgaggacaccgccctcttctactgcgcgaaggagcgccccctgcggctgctccgctacttcgactggctgagcgggggcgccaacgactactgggggcagggcaccctggtcaccgtgtccagc

SEQ ID NO: 12706 - RNA, 387 nt, synthetic construct
  misc_feature 1..387: note = derived and/or modified sequence opt1 from anti-influenza_Chain
  source 1..387: mol_type = other RNA
gaggtgcagctggtcgagagcggcgggggcgccgtgcagcccggggagtccctcaagctgagctgcgccgcgtccggcttcaccttcagcaactacgggatgcactgggtgcgccaggccccgggcaagggcctggagtgggtcgccgtgatctcctacgacgggagcaacaagtactacgccgactccgtgaagggccggttcaccatcagccgcgacaactccaaggacacgctctacctgcagatgaacagcctgcgggccgaggacaccgccctcttctactgcgcgaaggagcgccccctgcggctgctccgctacttcgactggctgtccgggggcgccaacgactactgggggcagggcaccctggtcaccgtgagctcc

SEQ ID NO: 12707 - RNA, 387 nt, synthetic construct
  misc_feature 1..387: note = derived and/or modified sequence opt1 from anti-influenza_Chain
  source 1..387: mol_type = other RNA
caggtgcagctggtcgagagcggcgggggcgtggtgcagcccgggcgctccctccggctgagctgcgccgtctccggcttcaccttcagctcctacgccatgcactgggtgcgccaggcgccggggaagggcctggagtgggtggccgtcatcagctacgacggctccaaccagtactacgccgacagcgtgaaggggcggttcaccatctcccgcgacaacagcaagaacacgctctacctgcagatgaactccctgcgggccgaggacaccgccctctactactgcgcgaaggacccccgcctgcggcacctcctgtacttccccttcaccagcatgatctacttcgactactggggccaggggaccctggtgacggtctccagc

SEQ ID NO: 12708 - RNA, 387 nt, synthetic construct
  misc_feature 1..387: note = derived and/or modified sequence opt1 from anti-influenza_Chain
  source 1..387: mol_type = other RNA
caggtgcagctggtccagagcggcgggggcgtggtgcagcccgggcgctccctccggctgagctgcgtcgcctccggcttcaccttcagcacctacgccatgcactgggtgcgccaggcgccggggcggggcctggagtgggtggccgtcatctcctacgacgccaactacaagtactacgccgacagcgtgaagggccgcttctccatcagccgggacaactcccagaacacgctccacctggagatgaacaccctgcgcaccgaggacaccgccctctactactgcgcgaaggacagccagctgcggtccctgctctacttcgagtggctgagccaggggtacttcgagccctggggccaggggacgctggtgaccgtcacctcc

SEQ ID NO: 12709 - RNA, 387 nt, synthetic construct
  misc_feature 1..387: note = derived and/or modified sequence opt1 from anti-influenza_Chain
  source 1..387: mol_type = other RNA
caggtgcagctggtccagagcggcgggggcgtggtgcagcccgggcgctccctccggctgagctgcgtcgcctccggcttcaccttcagcacctacgccatgcactgggtgcgccaggcgccggggcggggcctggagtgggtggccgtcatctcctacgacggcaactacaagtactacgccgacagcgtgaaggggcgcttctccatcagccgggacaactccaacagcacgctccacctggagatgaacaccctgcgcaccgaggacaccgccctctactactgcgccaaggactcccagctgcggagcctgctctacttcgagtggctgtcccagggctacttcgacccctgggggcagggcacgctggtgaccgtcaccagc

SEQ ID NO: 12710 - RNA, 387 nt, synthetic construct
  misc_feature 1..387: note = derived and/or modified sequence opt1 from anti-influenza_Chain
  source 1..387: mol_type = other RNA
caggtgcagctggtccagagcggcgccgaggtgaagaagcccgggtccagcgtgaccgtctcctgcaaggccagcggcgggaccttctccaactacggcatcagctgggtgcgccaggcgccggggcagggcctcgactggatgggcgggatcatccccctgttcggcacggccaactacgcccagaagttccaggggcgggtgaccatcaccgccgacgagtccaccagctccagcaacatggagctgtccagcctccgctccgaggacacggccgtctactactgcgcgcgggacgtgcacaactacgacttcctgaccggctaccccctgcacctctacgggatggacgtgtggggccagggcaccaccgtcacggtgagctcc

SEQ ID NO: 12711 - RNA, 387 nt, synthetic construct
  misc_feature 1..387: note = derived and/or modified sequence opt1 from anti-influenza_Chain
  source 1..387: mol_type = other RNA
caggtgcagctgcaggagagcggccccgggctcgtcaagccgtccgagaccctgagcctgatctgcgccgtgtccggcgccagcatctccagctcctactggagctggatccgccagccgcccgggaagggcctcgagtggatcgggtacatctactactccggcgtgaccaagtacaaccccagcctgaagtcccgggtcacgctgagcgtggacacctccaagaaccacttcagcctcaagctgtcctacgtgaccgcggccgacaccgccgtctactactgcgcccgcaacctgcccgacatcgccgtggtgacggcggtccaggacgccacccccgtgtggttcgacccctggggccccgggaccctcgtgagcgtctccagc

SEQ ID NO: 12712 - RNA, 387 nt, synthetic construct
  misc_feature 1..387: note = derived and/or modified sequence opt1 from anti-influenza_Chain
  source 1..387: mol_type = other RNA
gaggtgcagctggtcgagagcggcgggggcctcgtgcagcccgggcgctccctgcggctgagctgcgccgcctccggcttcaccttcagcgacttctggatgtcctgggtgcgccaggcgccggggaagggcctcgagtgggtcgccaacatcgaccaggacggcaacgagcggttctacgccgacagcgtgaaggggcgcttcaccatctcccgggacaacgccaagaacagcctgtacctgcagatgacgtccctccgcgccgacgacaccgcggtgtactactgcgcccgggacggccgcgaggggtacttctacggcagcgggtccttctacaacctgaagggcctgaactggggccaggggaccctcctgaccgtcagctcc

SEQ ID NO: 12713 - RNA, 387 nt, synthetic construct
  misc_feature 1..387: note = derived and/or modified sequence opt1 from anti-influenza_Chain
  source 1..387: mol_type = other RNA
gaggtgctgatggtcgagagcggcgggggcctcgtgcagcccgggggctccgtgcgcctgagctgcgtcgcctccgggttcagcttctccagccactggatgacctgggtgcggcaggccccgggcaagggcctggagtgggtggcgaacatcgaggacgacgggggcgacaagtactacgtcgactccgtgaaggggcgcttcatcatcagccgggacaacgccaagaactccgtgtacctccagatgaacagcctgcgcgccgaggacaccgccgtctacttctgcgcccggggctccgggagctccgaccgcagcgactacgacccccactactactactacctggacgtgtggggcaagggcgcgacggtgaccgtctccagc

SEQ ID NO: 12714 - RNA, 387 nt, synthetic construct
  misc_feature 1..387: note = derived and/or modified sequence opt1 from anti-influenza_Chain
  source 1..387: mol_type = other RNA
gaggtgcagctggtcgagagcggcggggacctcgtgcagcccggccgctccctgaagctgagctgcaccgggtccggcttcaccttcggggactacggcgtgacgtgggtccggcaggcccccggcaaggggctcgagtgggtgggcttcatccgcacccggccctggggcgggaccgccgacaccgcggccagcgtgaaggggcgcttcacgatctcccgggacgacagcaagtccctggcctacctgcagatgaacagcctcaagaccgaggacaccgccgtctactactgctgccgcgacgccccgcccaacgtggaggtggcgtccatgaccaactggtacttcgacctgtggggccggggcacgctggtcaccgtgagctcc

SEQ ID NO: 12715 - RNA, 387 nt, synthetic construct
  misc_feature 1..387: note = derived and/or modified sequence opt1 from anti-influenza_Chain
  source 1..387: mol_type = other RNA
gaggtgcagctggtccagagcggctccgaggtgaagaagcccggggagagcctcaagatctcctgcaagggcagcgggtactccttcagcaactactggatcggctgggtgcggcacatgccggggaagggcctggagtggatgggcatcatctaccccggggactccgacacccggtacagcccctccttccagggccaggtcaccatgagcgccgacaagtccagctccacggtgtacctgcagtggagctccctcaaggccagcgacaccgcgatctactactgcgcccgccgcgggggccactccttcgggtacggcagcggcggggacacccactccgagttcgacagctggggccaggggaccctggtgacggtcagctcc

SEQ ID NO: 12716 - RNA, 387 nt, synthetic construct
  misc_feature 1..387: note = derived and/or modified sequence opt1 from anti-influenza_Chain
  source 1..387: mol_type = other RNA
caggtgcagctgctcgagaccggcgggggcctggtcaagcccgggcagagcctgaagctctcctgcgccgccagcggcttcaccttcacgtcctacgcgatgcactgggtgcgccagccgcccgggaagggcctggagtgggtggccgtcgtgagctacgacggcaactacaagtactacgccgactccgtgcaggggcggttcaccatcagccgcgacaactccaagaacaccctgtacctccagatgaacagcctgcgggccgaggacaccgccgtctactactgcgcgaaggactcccgcctgcggagcctcctgtacttcgagtggctgtcccagggctacttcaacccctgggggcagggcacgaccctcaccgtgagctcc

SEQ ID NO: 12717 - RNA, 387 nt, synthetic construct
  misc_feature 1..387: note = derived and/or modified sequence opt1 from anti-influenza_Chain
  source 1..387: mol_type = other RNA
caggtgcagctggtcgagagcggcgccgaggtgaagaagcccggggcctccgtgaagctcagctgcaccgcgtccggctacaacttcgccgcctactacatccactgggtccgccaggccccggggcagggcctggagtggatggggtggagcaaccccaacaccggcggcgccaactacgcgcaggacttccaggggcgggtgacgatgaccgccgtgacctccaccagcacggcctacatggagctgtcccgcctcaccagcgacgacaccgccctgtacttctgcgcgcgggtcccccgcgaccggctgctcaccctgtactacgagtccagcacgtacggcttcgactactgggggcagggcaccctggtgaccgtgtccagc

SEQ ID NO: 12718 - RNA, 387 nt, synthetic construct
  misc_feature 1..387: note = derived and/or modified sequence opt1 from anti-influenza_Chain
  source 1..387: mol_type = other RNA
caggtgcagctggtcgagagcggcgggggcctcgtgcagcccgggggctccctgcgcctgagctgcaccgtgtccgggttcaccttcaacagctacgccatgaactgggtccggcaggccccgggcaagggcctcgagtgggtgtccgggatccgcggcagcggggagaacacgtactacgcggagaccgtgaagggccggttcaccatctcccgcgacaacagcaagaacaccctgtacctggagatgaactccctccgggccgaggacacggccgtctactactgcgcccgcaagtgggggcggatgaccgtgttcggcgtggccaccgaccagctgtactacttcgactactggggccaggggaccctggtcacggtgagctcc

SEQ ID NO: 12719 - RNA, 387 nt, synthetic construct
  misc_feature 1..387: note = derived and/or modified sequence opt1 from anti-influenza_Chain
  source 1..387: mol_type = other RNA
caggtgcagctggtcgagagcggccccgggctcgtgaagccgtcccagaccctgagcctgacctgcacggtgtccggcgggagcatctccaacggcgggtaccactggagctggatccgccagcaccccggcaagggcctcgagtggatcgggaacatctactaccggggctccaccttctacgaccccagcctgaagtcccgcgtcaccatcagcgtggacacctccaagagccagttctccctgaagctcacgagcgtgaccgccgccgacaccgcggtctactactgcgcccggatgcccctggccaactacgacctgctcaccgggctgtacatcggcgccttcgacctgtgggggcagggcacgatggtgaccgtgtccagc

SEQ ID NO: 12720 - RNA, 387 nt, synthetic construct
  misc_feature 1..387: note = derived and/or modified sequence opt1 from anti-influenza_Chain
  source 1..387: mol_type = other RNA
caggtgcagctggtcgagagcggcgccgaggtgaagaagcccggggcctccgtgcgcgtcagctgcaagggctccgggtacaccttcaccgcgtaccacatgcactgggtgcggcaggccccgggccaggggttcgagtgggtgggctggatcaaccccaacagcggcgccacgtactacacctccaccttcgaggggcgcgtcaccatgacgcgggacaccagcatcaccaccgcctacatggagctctccagcctgcgctccgacgacacggccgtgtactactgcgcgaccgacatcgtggtcgagcgggacgccagcctgggcgggttcaactcctacggcatggacgtgtgggggcagggcaccaccgtgacggtcagctcc

SEQ ID NO: 12721 - RNA, 390 nt, synthetic construct
  misc_feature 1..390: note = derived and/or modified sequence opt1 from anti-influenza_Chain
  source 1..390: mol_type = other RNA
caggtgcagctgcagcagtggggcgccgggctcctgaagcccagcgagaccctgtccctgacctgcgccgtctacggcgggagcttctccgtgagcggctactactggtcctggatccgccagccgcccgggcggggcctcgagtggatcggcgagatcagccacgggggctccacgaactacaaccccagcctgaagtcccgcgtgaccatcagcgtcgacaccaccaagaaccagttctccctccggctgagctccgtgacggcggccgacaccgccgtgtactactgcgcccgcgggaccgaccccgacaccgaggtctactgccgggtgggcaactgcgccgcgttcgactactgggggcagggcagcctggtgacggtctccagc

SEQ ID NO: 12722 - RNA, 390 nt, synthetic construct
  misc_feature 1..390: note = derived and/or modified sequence opt1 from anti-influenza_Chain
  source 1..390: mol_type = other RNA
caggtgcagctgctcgagagcggccccgggctggtcaagccgtcccagaccctgctcctgacctgcacggtgagcggcgcctccatcagcaccgggggcaactactggtcctggatccgccagcaccccgggaaggacctggagtggatcggctacatcttctacagcggcaccaccaagtacaacccctccgtggacaaccccagcctcaagtcccgggtcacgatgagcgtggacacctccgagaaccagttcagcctgaagctgtccagcgtgaccgccgcggacaccgccgtctacttctgcgcccgcgggtccccgaacagcggctacgactgggggccccacttcgactactggggccaggggacgctcgtgaccgtgtccagc

SEQ ID NO: 12723 - RNA, 390 nt, synthetic construct
  misc_feature 1..390: note = derived and/or modified sequence opt1 from anti-influenza_Chain
  source 1..390: mol_type = other RNA
gaggtgcagctggtcgagagcggcgggcacctcgtgcagcccggccgctccctgcggctgagctgcgccgcctccgggttcaccttcgaggactacgcgatgaactgggtgcgccaggccccgggcaaggggctcgagtgggtcagcgtgatctcctgggacagcggccggatcggctacgccgactccgtgaaggggcgcttcaccatcagccgggacaacgccaagaactccagctacctgcagatgaactccctgcgccccgaggacacggccctctactactgcgtccgggacatgctggcgtactacagcgacaactccggcaagaagtacaacgtgtacgggatggacgtgtggggccaggggaccaccgtcaccgtgagctcc

SEQ ID NO: 12724 - RNA, 390 nt, synthetic construct
  misc_feature 1..390: note = derived and/or modified sequence opt1 from anti-influenza_Chain
  source 1..390: mol_type = other RNA
gaggtgcagctggtcgagagcggcgggggcctcgtgcagcccgggcgctccctgcggctgagctgcgccgtgtccggcttcatcttcgaggactacgccatcaactgggtccgccaggcgccggggaagggcctcgagtgggtgagcatcatctcctgggacagcggccggatcgggtacgccgactccgtgcgcggccggttcaccatcagccgcgacaacgccaagaactccagcttcctgcagatgaactccctgcggcccgaggacaccgccgtctactactgcgtgaaggacatgctcgcctactactacgacgggagcggcatccgctacaacctgtacgggatggacgtgtggggccagggcacgaccgtcaccgtgtccagc

SEQ ID NO: 12725 - RNA, 390 nt, synthetic construct
  misc_feature 1..390: note = derived and/or modified sequence opt1 from anti-influenza_Chain
  source 1..390: mol_type = other RNA
gaggtgcagctggtcgagagcggcgggggcctcgtgcagcccgggcgctccctgcggctgagctgcgccgtgtccggcttcatcttcgaggactacgccatcaactgggtccgccaggcgccggggaagtgcctcgagtgggtgagcatcatctcctgggacagcggccggatcggctacgccgactccgtgcgcgggcggttcaccatcagccgcgacaacgccaagaactccagcttcctgcagatgaactccctgcggcccgaggacaccgccgtctactactgcgtgaaggacatgctcgcctactactacgacggcagcgggatccgctacaacctgtacggcatggacgtgtgggggcagggcacgaccgtcaccgtgtccagc

SEQ ID NO: 12726 - RNA, 396 nt, synthetic construct
  misc_feature 1..396: note = derived and/or modified sequence opt1 from anti-influenza_Chain
  source 1..396: mol_type = other RNA
cagatcaccctgaaggagagcggccccaccctcgtgaagccgacgcagaccctgaccctgacctgcgtcttctccgggttcagcctctccatcacgggcgtgcgcgtggggtggatccggcagccgcccggcaaggccctggagtggctggccctcatcagctgggacgacgagaagcactactcccccagcctgcagtcccgcctgaccatcaccaaggacaccagcaagaaccaggtcgtgctcacgatgaccaacctggaccccgtggacaccgcgacctactactgcgcccggtccacggaccgcgggcacgtcctgcggtacttcggctggatgctccccggcgacgccttcgacgtgtgggggcagggcaccatggtgaccgtcagctcc

SEQ ID NO: 12727 - RNA, 396 nt, synthetic construct
  misc_feature 1..396: note = derived and/or modified sequence opt1 from anti-influenza_Chain
  source 1..396: mol_type = other RNA
caggtgcagctgcaggagagcggccccgggctcgtcaagccgtccgagaccctgagcctgacctgcacggtgtccagcggccccatgtccgactactactggagctggatccgccagccgcccgggaagggcctcgagtggatcgggcacgtgtccgtcagccacggcggccggaccaagtccaaccccagcgtgatgtcccgcgtgaccatcagcgtcgagacctccaagaaccagttcagcctgaagctgacgtccgtgaccgccgccgacaccgcggtgtactactgcgcccggctcaactactacgaccgcagcgggtaccactcccccgacggccccagcaacaactggttcgacccctgggggcagggcaccctggtcacggtgtccagc

SEQ ID NO: 12728 - RNA, 396 nt, synthetic construct
  misc_feature 1..396: note = derived and/or modified sequence opt1 from anti-influenza_Chain
  source 1..396: mol_type = other RNA
caggtgcagctggtccagagcggcgccgaggtgaagaagcccggggcctccgtgaaggtcagctgcaagacctccggctacaccttcacggcgtacaccatccactgggtgcgccaggccccggggcagcggctcgagtggatgggctggatcaacgccgggaacggccacaccaagtacagccagcgcttcaagggccgggtgaccatcacgcgcgacacctccgcccggaccacctacatggagctgcgcagcctgacgtccgaggacaccgccctctacttctgcgcgcgggggcccgagacctactactacgacaagaccaactggctgaacagccaccccgacgagtacttccagcactggggccacgggacgcaggtcaccgtgtccagc

SEQ ID NO: 12729 - RNA, 399 nt, synthetic construct
  misc_feature 1..399: note = derived and/or modified sequence opt1 from anti-influenza_Chain
  source 1..399: mol_type = other RNA
caggtgcagctggtccagagcggctccgaggtgaagaagcccggggccagcgtgaaggtctcctgcaaggccagcggctacaccttcaccaactacgacatcaactggatccgccaggcgccggggcagggcctcgagtggatggggtggatcaaccccaactccggcacgaccggcagcgcccagcggttccaggggcgcgtgaccatcaccgtggacacgtccatcaccaccgtctacatggagctgagctccctgcggagcgacgacaccgccatctactactgcgcccgcggccgggagctcctgcgcctgcagcacttcctcacggactcccagagcgagcggcgcgactgcttcgacccctgggggcagggcaccctggtgaccgtgtccagc

SEQ ID NO: 12730 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggctcagcttcctgaacgcgtggatgtcctgggtgcggcaggccccgggcaagggcctggagtgggtcgggcgcatcaagagcaacaccgacggcgggaccacggactacgccgcccccgtgaagggccggttcaccatctcccgcgacgacagcaagaacaccctctacctgcagatgtccagcctgaagaccgaggacacggccgtgtactactgcaccaccgacgggccctactccgacgacttccggagcggctacgcggcccgctaccggtacttcggcatggacgtctgggggcagggcaccacggtgaccgtgtccagc

SEQ ID NO: 12731 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggttcagcttcctcaacgcgtggatgtcctgggtgcggcaggccccgggcaagggcctggagtgggtcgggcgcatcaagagcaacaccgacggcgggaccacggactacgccgcccccgtgaagggccggttcaccatctcccgcgacgacagcaagaacaccctgtacctccagatgtccagcctgaagaccgaggacacggccgtgtactactgcaccaccgacgggccctactccgacgacttccggagcggctacgcggcccgctaccggtacttcggcatggacgtctgggggcagggcaccacggtgaccgtgtccagc

SEQ ID NO: 12732 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggctcaccttcctgaacgcgtggatgagctgggtgcggcaggccccgggcaagggcctggagtgggtcgggcgcatcaagtccaacaccgacggcgggacgaccgactacgccgcccccgtgaagggccggttcaccatcagccgcgacgactccaagaacaccctctacctgcagatgagctccctgaagacggaggacaccgccgtgtactactgcaccaccgacgggccctacagcgacgacttccggtccggctacgcggcccgctaccggtacttcggcatggacgtctgggggcagggcacgaccgtgaccgtgagctcc

SEQ ID NO: 12733 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggttcagcttctccaacgcgtggatgagctgggtgcggcaggccccgggcaagggcctcgagtgggtcgggcgcatcaagtccaacaccgacggcgggaccacggactacgccgcccccgtgaagggccggttcaccatcagccgcgacgactccaagaacaccctgtacctgcagatgagctccctcaagaccgaggacacggccgtgtactactgcaccaccgacgggccctacagcgacgacttccggtccggctacgcggcccgctaccggtacttcggcatggacgtctgggggcagggcaccacggtgaccgtgagctcc

SEQ ID NO: 12734 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggctcaccttcagcaacgcgtggatgtcctgggtgcggcaggccccgggcaagggcctggagtgggtcgggcgcatcaagagcaacaccgacggcgggacgaccgactacgccgcccccgtgaagggccggttcaccatctcccgcgacgacagcaagaacaccctgtacctccagatgtccagcctgaagacggaggacaccgccgtgtactactgcaccaccgacgggccctactccgacgacttccggagcggctacgcggcccgctaccggtacttcggcatggacgtctgggggcagggcacgaccgtgaccgtgtccagc

SEQ ID NO: 12735 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggttcaccttcagcaacgcgtggatgtcctgggtgcggcaggccccgggcaagggcctcgagtgggtcgggcgcatcaagagcaacaccgacggcgggacgaccgactacgccgcccccgtgaagggccggttcaccatctcccgcgacgacagcaagaacaccctgtacctgcagatgtccagcctcaagacggaggacaccgccgtgtactactgcaccaccgacgggccctactccgacgacttccggagcggctacgcggcccgctaccggtacttcggcatggacgtctgggggcagggcacgaccgtgaccgtgtccagc

SEQ ID NO: 12736 - RNA, 402 nt, synthetic construct
  misc_feature 1..402: note = derived and/or modified sequence opt1 from anti-influenza_Chain
  source 1..402: mol_type = other RNA
gaggtgcagctggtcgtgagcggcgggggcctcgtgaagcccgggggctccctgcgcctgagctgcgccgcctccgggctcagcttcctgaacgcgtggatgtcctgggtccggcaggccccgggcaagggcctggagtgggtggggcgcatcaagagcaacaccgacggcgggaccacggactacgccgcccccgtgaagggccggttctccatcagccgcgacgactccaagaacatgctgttcctccacatgagctccctgcggaccgaggacaccgccgtctactactgcgcgaccgacgggccctacagcgacgacttccgctccggctacgccgcccggtaccgctacttcggcatggacgtgtgggggcagggcacgaccgtgaccgtcagctcc

SEQ ID NO: 12737 - RNA, 402 nt, synthetic construct
  misc_feature 1..402: note = derived and/or modified sequence opt1 from anti-influenza_Chain
  source 1..402: mol_type = other RNA
gaggtgcagctggtcgtgagcggcgggggcctcgtgaagcccgggggctccctgcgcctgagctgcgccgcctccgggctcagcttcctgaacgcgtggatgtcctgggtccggcaggccccgggcaagtgcctggagtgggtgggccgcatcaagagcaacaccgacgggggcaccacggactacgccgcccccgtgaaggggcggttctccatcagccgcgacgactccaagaacatgctgttcctccacatgagctccctgcggaccgaggacaccgccgtctactactgcgcgaccgacggcccctacagcgacgacttccgctccgggtacgccgcccggtaccgctacttcggcatggacgtgtggggccaggggacgaccgtgaccgtcagctcc

SEQ ID NO: 12738 - RNA, 402 nt, synthetic construct
  misc_feature 1..402: note = derived and/or modified sequence opt1 from anti-influenza_Chain
  source 1..402: mol_type = other RNA
gaggtgcagctggtcgtgagcggcgggggcctcgtgaagcccgggggctccctgcgcctgagctgcgccgcctccgggctcagcttcctgaacgcgtggatgtcctgggtccggcaggccccgggcaagggcctggagtgggtggggcgcatcaagagcaacaccgacggcgggaccacggactacgccgcccccgtgaagggccggttctccatcagccgcgacgactccaagaacatgctgttcctccacatgagctccctgcggaccgaggacaccgccgtctactactgcgcgaccgacgggccctacagcgacgacttccgctccggctacgccgcccggtaccgctacttcggcatggacgtgtgggggtgcggcacgaccgtgaccgtcagctcc

SEQ ID NO: 12739 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggttcaccttcctcaacgcgtggatgagctgggtgcggcaggccccgggcaagggcctggagtgggtcgggcgcatcaagtccaacaccgacggcgggacgaccgactacgccgcccccgtgaagggccggttcaccatcagccgcgacgactccaagaacaccctgtacctccagatgagctccctgaagacggaggacaccgccgtgtactactgcaccaccgacgggccctacagcgacgacttccggtccggctacgcggcccgctaccggtacttcggcatggacgtctgggggcagggcacgaccgtgaccgtgagctcc

SEQ ID NO: 12740 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggttcaccttcctcaacgcgtggatgagctgggtgcggcaggccccgggcaagtgcctggagtgggtcggccgcatcaagtccaacaccgacgggggcacgaccgactacgccgcccccgtgaaggggcggttcaccatcagccgcgacgactccaagaacaccctgtacctccagatgagctccctgaagacggaggacaccgccgtgtactactgcaccaccgacggcccctacagcgacgacttccggtccgggtacgcggcccgctaccggtacttcggcatggacgtctggggccaggggacgaccgtgaccgtgagctcc

SEQ ID NO: 12741 - RNA, 402 nt, synthetic construct
  misc_feature 1..402: note = derived and/or modified sequence opt1 from anti-influenza_Chain
  source 1..402: mol_type = other RNA
gaggtgcagctggtcgagagcggcgggggcctcgtgaagcccgggggctccctgcgcctgagctgcgccgcctccgggttcaccttcctcaacgcgtggatgagctgggtgcggcaggccccgggcaagggcctggagtgggtcgggcgcatcaagtccaacaccgacggcgggacgaccgactacgccgcccccgtgaagggccggttcaccatcagccgcgacgactccaagaacaccctgtacctccagatgagctccctgaagacggaggacaccgccgtgtactactgcaccaccgacgggccctacagcgacgacttccggtccggctacgcggcccgctaccggtacttcggcatggacgtctgggggtgcggcacgaccgtgaccgtgagctcc

SEQ ID NO: 12742 - RNA, 414 nt, synthetic construct
  misc_feature 1..414: note = derived and/or modified sequence opt1 from anti-influenza_Chain
  source 1..414: mol_type = other RNA
caggtgcagctgcaggagagcggcgggggcctcgtccagcccggggagtccctgcgcctgagctgcgtgggctccgggagctccttcggcgagagcaccctctcctactacgccgtgagctgggtccggcaggccccgggcaaggggctggagtggctgtccatcatcaacgcgggcgggggcgacatcgactacgccgacagcgtggaggggcgcttcaccatctcccgggacaacagcaaggagacgctctacctgcagatgaccaacctgcgcgtggaggacaccggcgtctactactgcgccaagcacatgtccatgcagcaggtcgtgagcgccggctgggagcgggccgacctcgtgggggacgcgttcgacgtgtggggccaggggaccatggtgacggtctccagc

SEQ ID NO: 12743 - RNA, 465 nt, synthetic construct
  misc_feature 1..465: note = derived and/or modified sequence opt1 from anti-influenza_Chain
  source 1..465: mol_type = other RNA
ctgagccgcatcaaccacttcgagaagatccagatcatccccaagtccagctggtccgaccacgaggccagctccggcgtgagctccgcctgcccgtaccaggggacccccagcttcttccggaacgtcgtgtggctcatcaagaagaacaacacctaccccacgatcaagcgctcctacaacaacaccaaccaggaggacctgctgatcctctggggcatccaccacagcaacgacgcggccgagcagaccaagctgtaccagaaccccaccacgtacatctccgtggggaccagcaccctgaaccagcggctcgtcccgaagatcgccacccgctccaaggtgaacggccagaacgggcggatggacttcttctggacgatcctgaagcccaacgacgccatcaacttcgagagcaacggcaacttcatcgcccccgagtacgcgtacaagatcgtgaagaag

SEQ ID NO: 12744 - RNA, 564 nt, synthetic construct
  misc_feature 1..564: note = derived and/or modified sequence opt1 from anti-influenza_Chain
  source 1..564: mol_type = other RNA
aacgtgcccgagtggagctacatcgtcgagaaggccaacccggccaacgacctgtgctaccccggcaacttcaacgactacgaggagctcaagcacctcctgtcccgcatcaaccacttcgagaagatccagatcatccccaagagctcctggagcgaccacgaggcgtccagcggggtgtccagcgcctgcccctaccagggcaccccgtccttcttccggaacgtggtctggctgatcaagaagaacaacacctaccccacgatcaagcgcagctacaacaacaccaaccaggaggacctgctgatcctctgggggatccaccactccaacgacgccgccgagcagaccaagctgtaccagaaccccaccacgtacatcagcgtgggcacctccaccctgaaccagcggctcgtgcccaagatcgccacccgcagcaaggtcaacgggcagaacggccggatggacttcttctggacgatcctgaagccgaacgacgcgatcaacttcgagtccaacggcaacttcatcgcccccgagtacgcctacaagatcgtgaagaag

SEQ ID NO: 12745 - RNA, 609 nt, synthetic construct
  misc_feature 1..609: note = derived and/or modified sequence opt1 from anti-influenza_Chain
  source 1..609: mol_type = other RNA
atgctgcgcagcctcgtgctgaacgagaagctgcgggcccgcgtcctcgagcgggccgaggagttcctgctgaacaacaaggcggacgaggaggtgtggttccgcgagctcgtgctgtgcatcctgacctccaacagctccttcatcagcgcctacaagtccatgaactacatcctcgacaagatcctgtacatggacgagaaggagatcagcatcctgctccaggagtccggctaccggttctacaacctgaaggccaagtacctgtaccgcgccaagaacctctacgggaaggtcaagaagaccatcaaggagatcgccgacaaggaccagatgcaggcgcgggagttcatcgccacgcacatctacggcatcgggtacaaggaggccagccacttcctgcgcaacgtgggctacctggacctcgccatcatcgaccggcacatcctgcgcttcatcaacaacctggggatccccatcaagctcaagtccaagcgggagtacctgctggcggagagcctcctgcgctccatcgccaacaacctgaacgtgcaggtcggcctcctggacctgttcatcttcttcaagcagaccaacaccatcgtgaag

SEQ ID NO: 12746 - RNA, 615 nt, synthetic construct
  misc_feature 1..615: note = derived and/or modified sequence opt1 from anti-influenza_Chain
  source 1..615: mol_type = other RNA
ggcctgttcggggccatcgccggcttcatcgagggcgggtggaccgggatggtggacggctggtacggctaccaccaccagaacgagcaggggagcggctacgcggccgacctcaagtccacccagaacgccatcgacgagatcacgaacaaggtcaacagcgtgatcgagaagatgaacacccagttcaccgccgtggggaaggagttcaaccacctggagaagcgcatcgagaacctgaacaagaagatcgacgacggcttcctcgacatctggacctacaacgccgagctgctggtcctcctggagaacgagcggacgctggactaccacgactccaacgtgaagaacctctacgagaaggtgcgcagccagctgaagaacaacgcgaaggagatcgggaacggctgcttcgagttctaccacaagtgcgacaacacgtgcatggagtccgtcaagaacggcacctacgactaccccaagtacagcgaggaggccaagctgaaccgggaggagatcgacggggtgaagctcgagtccacccgcatctaccagatcctggccatctacagcaccgtggcctccagcctggtcctcgtggtgtccctgggcgcg

SEQ ID NO: 12747 - RNA, 639 nt, synthetic construct
  misc_feature 1..639: note = derived and/or modified sequence opt1 from anti-influenza_Chain
  source 1..639: mol_type = other RNA
gagatcgtgctgacccagagccccggcaccctctccctgagcccgggggagcgcgccacgctgtcctgccgggccagccagcgcgtctccagctacctcgcgtggtaccagcagaagcccggccaggcgccccggctgctgatctacggggcctccacccgcgccgccggcatccccgaccggttcagcgggtccggcagcggcaccgacttcaccctcacgatctcccgcctggagccggaggacagcgccgtgtactactgccagcagtacgggcggacgcccctgaccttcggcgggggcaccaaggtggagatcaagcgcgccgccgccccctccgtcttcatcttcccgcccagcgacgagcagctcaagtccgggaccgcgagcgtggtgtgcctgctgaacaacttctacccccgggaggccaaggtccagtggaaggtggacaacgccctccagtccggcaacagccaggagtccgtgaccgagcaggacagcaaggacagcacctactccctgagctccaccctgacgctcagcaaggccgactacgagaagcacaaggtctacgcctgcgaggtgacccaccagggcctgtccagccccgtgaccaagtccttcaaccgcggggagtgc

SEQ ID NO: 12748 - RNA, 639 nt, synthetic construct
  misc_feature 1..639: note = derived and/or modified sequence opt1 from anti-influenza_Chain
  source 1..639: mol_type = other RNA
gacatccagatgacccagagcccctccagcctgtccgccagcctcggcgggaacgtgaccatcacgtgcaaggcctcccaggacatcaacaagtacatcgcgtggtaccagcacaagccgggcaaggggccccgcctggtcatccactacaccagcaccctgcagcccggcatcccctcccggttcagcgggtccggcagcggcaccgactactccttcagcatctccaacctcgagccggaggacatcgccacgtactactgcctgcagtacgacatcctgtacaccttcgggggcgggaccaagctcgagatcaagcgcgccgacgccgcccccaccgtgagcatcttcccgccctccagcgagcagctgacgtccggcggggcgagcgtggtctgcttcctgaacaacttctaccccaaggacatcaacgtgaagtggaagatcgacggctccgagcggcagaacggcgtgctcaacagctggaccgaccaggacagcaaggactccacctacagcatgtccagcaccctgacgctgaccaaggacgagtacgagcgccacaactcctacacgtgcgaggccacccacaagaccagcacctcccccatcgtcaagagcttcaaccggaacgagtgc

SEQ ID NO: 12749 - RNA, 642 nt, synthetic construct
  misc_feature 1..642: note = derived and/or modified sequence opt1 from anti-influenza_Chain
  source 1..642: mol_type = other RNA
gacatccagatgacccagagcccctccagcctgtccgccagcgtgggcgaccgcgtcaccatcacgtgccgggcctcccaggggatcagctcctacctcgcgtggtaccagcagaagccgggcaaggtgcccaccctgctgatctacgacgccagcaccctccgctccggggtgcccagccggttctccggcagcgggtccgccaccgacttcacgctgaccatcagctccctgcagcccgaggacgtcgccacctactactgccagcgctacaacagcgccccgcccatcaccttcggccagggcacgcggctcgagatcaagcgcgcggccgccccctccgtgttcatcttcccgcccagcgacgagcagctgaagtccgggaccgccagcgtggtctgcctgctcaacaacttctacccccgggaggcgaaggtgcagtggaaggtggacaacgccctgcagagcggcaactcccaggagagcgtcaccgagcaggactccaaggacagcacctactccctgagctccacgctcaccctgagcaaggccgactacgagaagcacaaggtgtacgcctgcgaggtgacccaccaggggctgtccagccccgtcaccaagtccttcaaccgcggcgagtgc

SEQ ID NO: 12750 - RNA, 642 nt, synthetic construct
  misc_feature 1..642: note = derived and/or modified sequence opt1 from anti-influenza_Chain
  source 1..642: mol_type = other RNA
gagatcgtgctgacccagagccccggcaccctctccctgagcccgggggagcgggccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcccccgcaccttcggcgggggcaccaaggtggagatcaagcgggccgccgccccctccgtcttcatcttcccgcccagcgacgagcagctgaagtccgggaccgccagcgtggtgtgcctcctgaacaacttctacccccgcgaggcgaaggtccagtggaaggtggacaacgccctgcagagcggcaactcccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgcggggagtgc

SEQ ID NO: 12751 - RNA, 642 nt, synthetic construct
  misc_feature 1..642: note = derived and/or modified sequence opt1 from anti-influenza_Chain
  source 1..642: mol_type = other RNA
agctacgtgctgacccagcccccgtccgtcagcgtggcccccggcgagaccgccacggtgacctgcgggggcaacaacatcgggtccaagagcgtccactggtaccagcagaagcccggccaggcgcccgtggtggtcatctactacgacggggaccgcccgtccggcatccccgagcggttcagcggctccaacagcggggacaccgccaccctcacgatctcccgcgtggaggccggcgacgaggccgactactactgcctggtgtgggactacaccagcgtccactacgtgttcgggaccggcaccaaggtgacggtcctggggcagcccaaggccaaccccaccgtgaccctcttcccgccctccagcgaggagctgcaggcgaacaaggccaccctggtgtgcctcatctccgacttctaccccggcgccgtcacggtggcctggaaggcggacggcagccccgtgaaggccggggtcgagaccaccaagccgtccaagcagagcaacaacaagtacgccgcctccagctacctgtccctgacccccgagcagtggaagtcccaccggagctacagctgccaggtgacgcacgagggcagcaccgtggagaagaccgtcgcccccaccgagtgctcc

SEQ ID NO: 12752 - RNA, 642 nt, synthetic construct
  misc_feature 1..642: note = derived and/or modified sequence opt1 from anti-influenza_Chain
  source 1..642: mol_type = other RNA
gacatccagatgacccagaccagctccagcctgtccgccagcctcggcgaccgcgtgacgatctcctgccgggccagccaggacatccgcaactacctgaactggtaccagcagaagcccgacgggaccgtcaagctgctcatctactacacctcccggctgcacagcggcgtgccgtcccgcttcagcgactccgggagcggcaccgactactccctgacgatcagcaacctcgagcaggaggacctggcgacctacttctgccagcagacctacaccctgccctggacgttcgggggcggcaccaagctcgagatcaagcgggccgacgccgcccccaccgtgtccatcttcccgcccagctccgagcagctgaccagcgggggcgcctccgtcgtgtgcttcctgaacaacttctaccccaaggacatcaacgtgaagtggaagatcgacgggagcgagcgccagaacggcgtcctcaacagctggacggaccaggactccaaggacagcacctactccatgagctccaccctgaccctgacgaaggacgagtacgagcggcacaacagctacacgtgcgaggcgacccacaagacctccaccagccccatcgtgaagtccttcaaccgcaacgagtgc

SEQ ID NO: 12753 - RNA, 645 nt, synthetic construct
  misc_feature 1..645: note = derived and/or modified sequence opt1 from anti-influenza_Chain
  source 1..645: mol_type = other RNA
gacggcgtgaagcccctgatcctccgcgactgcagcgtcgccgggtggctgctgggcaacccgatgtgcgacgagttcatcaacgtgcccgagtggtcctacatcgtggagaaggccaaccccgcgaacgacctctgctaccccgggaacttcaacgactacgaggagctgaagcacctcctgagccggatcaaccacttcgagaagatccagatcatcccgaagtccagctggtccgaccacgaggccagctccggcgtcagctccgcctgcccctaccaggggacccccagcttcttccgcaacgtggtgtggctgatcaagaagaacaacacctaccccacgatcaagcggtcctacaacaacaccaaccaggaggacctgctcatcctgtggggcatccaccacagcaacgacgccgccgagcagaccaagctgtaccagaacccgaccacgtacatctccgtcggcaccagcaccctcaaccagcgcctggtgcccaagatcgcgacccggtccaaggtgaacgggcagaacggccgcatggacttcttctggacgatcctgaagcccaacgacgccatcaacttcgagagcaacgggaacttcatcgcccccgagtacgcctacaagatcgtcaagaag

SEQ ID NO: 12754 - RNA, 645 nt, synthetic construct
  misc_feature 1..645: note = derived and/or modified sequence opt1 from anti-influenza_Chain
  source 1..645: mol_type = other RNA
gacatccagatgacccagagcccctccaccctgagcgcctccgtgggcgaccgggtcacgatcacgtgccgggccagccagaccatcaacaactacctcgcgtggtaccagcagaagccggggaaggcccccaagctgctgatctacaaggcctccagcctcgagtccggcgtgcccagccgcttctccgggagcggctccgggaccgagttcaccctgaccatcagctccctgcagcccgacgacttcgccacctactactgccaggagtacaacaacgacagcccgctcaccttcggcggcgggacgaaggtggagatcaagcggaccgtcgccgcgccctccgtgttcatcttcccgcccagcgacgagcagctgaagtccggcaccgccagcgtggtctgcctgctcaacaacttctacccccgcgaggccaaggtgcagtggaaggtggacaacgccctgcagtccgggaacagccaggagagcgtcaccgagcaggactccaaggacagcacgtactccctgagctccaccctcaccctgagcaaggcggactacgagaagcacaaggtgtacgcctgcgaggtgacccaccagggcctgtccagccccgtcacgaagtccttcaaccgcggggagtgc

SEQ ID NO: 12755 - RNA, 645 nt, synthetic construct
  misc_feature 1..645: note = derived and/or modified sequence opt1 from anti-influenza_Chain
  source 1..645: mol_type = other RNA
agcgtgctgacccagcccccgtccgccagcggctcccgcgggcagagcatcaccatctcctgcacgggcagcacctccgacatcgggagctacaactacgtctcctggtaccagcagcaccccggcaccgcccccaaggtgatcctctacgaggtgagccagcggccctccggggtcccggaccgcttcagcggctccaagagcggcaacaccgcgttcctgacggtgtccgggctgcaggccgaggacgaggccgactactactgcgccagctacgccggcaacaacatctacgtgttcgggtccggcaccaaggtcaccgtgctcgggcagcccaaggcgaaccccaccgtgacgctgttcccgcccagctccgaggagctgcaggccaacaaggccaccctcgtctgcctgatcagcgacttctaccccggcgccgtgaccgtggcgtggaaggccgacagctcccccgtcaaggccggcgtggagaccacgacccccagcaagcagtccaacaacaagtacgccgccagctcctacctgagcctcaccccggagcagtggaagtcccacaagagctactcctgccaggtgacccacgaggggagcacggtcgagaagaccgtggcgcccaccgagtgctcc

SEQ ID NO: 12756 - RNA, 645 nt, synthetic construct
  misc_feature 1..645: note = derived and/or modified sequence opt1 from anti-influenza_Chain
  source 1..645: mol_type = other RNA
agcgccctgacccagcccccgtccgccagcggctcccgcgggcagagcatcaccatctcctgcacgggcagcacctccgacatcgggagctacaactacgtgtcctggtaccagcagcaccccggcaccgcgcccaaggtcatcctctacgaggtgagccagcggccctccggggtgccggaccgcttcagcggctccaagagcggcaacaccgccttcctgacggtctccgggctgcaggccgaggacgaggccgactactactgcgccagctacgcgggcaacaacatctacgtgttcgggtccggcaccaaggtgaccgtcctcgggcagcccaaggccaaccccaccgtgacgctgttcccgcccagctccgaggagctgcaggccaacaaggccaccctcgtgtgcctgatcagcgacttctaccccggcgcggtcaccgtggcctggaaggccgacagctcccccgtgaaggccggcgtcgagaccacgacccccagcaagcagtccaacaacaagtacgccgcgagctcctacctgagcctcaccccggagcagtggaagtcccacaagagctactcctgccaggtgacccacgaggggagcacggtggagaagaccgtcgcccccaccgagtgctcc

SEQ ID NO: 12757 - RNA, 648 nt, synthetic construct
  misc_feature 1..648: note = derived and/or modified sequence opt1 from anti-influenza_Chain
  source 1..648: mol_type = other RNA
cagagcgtgctgacccagcccccgtccgagagcgtctcccccggccagaccgccagcgtgacgtgctccgggcacaagctcggcgacaagtacgtgagctggtaccagcagaagcccgggcagtcccccgtcctgctgatctaccaggacaaccgccggccgagcggcatccccgagcgcttcatcgggtccaacagcggcaacaccgccaccctcaccatctccggcacgcaggcgctggacgaggccgactactactgccaggcctgggacagctccaccgccgtgttcgggggcgggaccaagctgaccgtgctcggcgccgcggccgggcagcccaaggccgcccccagcgtcacgctgttcccgccctccagcgaggagctgcaggcgaacaaggccaccctcgtgtgcctgatctccgacttctaccccggcgccgtgaccgtcgcctggaaggccgacagctcccccgtgaaggcgggcgtggagaccacgaccccgagcaagcagagcaacaacaagtacgccgcctccagctacctgtccctcacccccgagcagtggaagtcccaccggagctacagctgccaggtcacccacgaggggtccacggtggagaagaccgtggcccccaccgagtgcagc

SEQ ID NO: 12758 - RNA, 648 nt, synthetic construct
  misc_feature 1..648: note = derived and/or modified sequence opt1 from anti-influenza_Chain
  source 1..648: mol_type = other RNA
cagagcgccctgacccagcccgcctccgtgagcggctccccggggcagagcatcaccatctcctgcacgggcaccagctccgacgtcgggagctacaacctcgtgtcctggtaccagcagcaccccggcaaggcgcccaagctgatgatctacgaggtgagcaagcgcccctccggggtcagcaaccggttctccggcagcaagtccggcaacaccgccagcctgaccatctccgggctccaggccgaggacgaggccgactactactgccacctgtacgtgggcagctccaactgggtgttcgggggcgggacgaagctggccgtcctcggccagccgaaggcggcccccagcgtgaccctgttcccgcccagctccaaggagctgcaggccaacaaggccaccctcgtgtgccccatcagcgacttctaccccggcgcggtcaccgtggcctggaaggccgactccagccccgtgaaggccggggtcgagacgaccaccccctccaagcagagcaacaacaagtacgccgcgtccagctacctgtccctgaccccggagcagtggaagtcccacaagagctacagctgccaggtgacgcacgagggctccaccgtggagaagaccgtcgcccccaccgagtgcagc

SEQ ID NO: 12759 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtggacagcaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactggccgccccggctgaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 12760 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtgagccacaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactacccgccccggctgaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 12761 - RNA, 648 nt, synthetic construct
  misc_feature 1..648: note = derived and/or modified sequence opt1 from anti-influenza_Chain
  source 1..648: mol_type = other RNA
gagatcgtgatgacccagagccccgccaccctgtccgtcagcccgggcgagcgcgccacgctctcctgccgggcgagccagtccgtggacagcaacctggcctggtaccagcagaagcccgggcaggcgccccgcctgctcgtgtactccgccagcacccgggccaccggcatccccgcccgcttctccgggagcggctccgggaccgagttcacgctggccatcagctccctgcagagcgaggacttcgccgtctactactgccagcactacaccaactggccgccccggctcaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctgtccagcaccctcacgctgtccaaggccgactacgagaagcacaaggtctacgcgtgcgaggtgacccaccagggcctgagctcccccgtgaccaagagcttcaaccgcggggagtgc

SEQ ID NO: 12762 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtgagctccaacctggcctggtaccagcagaagcccgggcaggcgccccgcctcctggtgtacagcgcctccacccgggccaccggcatccccgcccgcttcagcgggtccggcagcgggaccgagttcacgctggccatctccagcctccagtccgaggacttcgccgtctactactgccagcactacaccaactggccgccccggctgaccttcggcggcgggagcaaggtggagatcaagcgcaccgtggccgcgccctccgtcttcatcttcccgcccagcgacgagcagctgaagtccggcacggccagcgtggtgtgcctcctgaacaacttctacccccgggaggccaaggtccagtggaaggtggacaacgccctgcagagcgggaactcccaggagagcgtgaccgagcaggactccaaggacagcacctactccctcagctccaccctgacgctgagcaaggccgactacgagaagcacaaggtctacgcgtgcgaggtgacccaccagggcctctccagccccgtgaccaagtccttcaaccgcggggagtgc

SEQ ID NO: 12763 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtggaccacaacctggcctggtaccagcagaagcccgggcaggcgccccgcctcctggtgtacagcgcctccacccgggccaccggcatccccgcccgcttcagcgggtccggcagcgggaccgagttcacgctggccatctccagcctccagtccgaggacttcgccgtctactactgccagcactacaccaactggccgccccggctgaccttcggcggcgggagcaaggtggagatcaagcgcaccgtggccgcgccctccgtcttcatcttcccgcccagcgacgagcagctgaagtccggcacggccagcgtggtgtgcctcctgaacaacttctacccccgggaggccaaggtccagtggaaggtggacaacgccctgcagtccgggaacagccaggagagcgtgaccgagcaggactccaaggacagcacctactccctcagctccaccctgacgctgagcaaggccgactacgagaagcacaaggtctacgcgtgcgaggtgacccaccagggcctctccagccccgtgaccaagtccttcaaccgcggggagtgc

SEQ ID NO: 12764 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtgagccacaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactggccgccccggctgaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 12765 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtgagccacaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaacttcccgccccggctgaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 12766 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtggacagcaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaacttcccgccccggctgaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 12767 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccagtccgtggacagcaacctggcctggtaccagcagaagcccgggcaggcgccccgcctcctggtgtactccgccagcacccgggccaccggcatccccgcccgcttctccgggagcggctccgggaccgagttcacgctggccatcagctccctccagagcgaggacttcgccgtctactactgccagcactacaccaactacccgccccggctgaccttcggcggcgggtccaaggtggagatcaagcgcaccgtggccgcgcccagcgtcttcatcttcccgccctccgacgagcagctcaagagcggcacggcctccgtggtgtgcctgctgaacaacttctacccccgggaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 12768 - RNA, 648 nt, synthetic construct
  misc_feature 1..648: note = derived and/or modified sequence opt1 from anti-influenza_Chain
  source 1..648: mol_type = other RNA
gagaccaccctgacgcagagccccgccaccctctccgtgagcccgggcgagcgcgccaccctgtcctgccgggcgagccaggtcatctcccacaacctggcctggtaccagcagaagcccgggcaggcgccccgcctcctgatctacggcgccagcacccgggcctccgggatccccgcccgcttcagcggctccgggagcggcacggactacaccctgaccatcacctccctccagagcgaggacttcgccgtgtactactgccagcactactccaactggccgccccggctgacgttcggcgggggcaccaaggtggagatcaagcgcaccgtcgccgcccccagcgtgttcatcttcccgccctccgacgagcagctcaagagcgggaccgcgtccgtggtctgcctgctgaacaacttctacccccgggaggccaaggtgcagtggaaggtggacaacgccctgcagagcggcaactcccaggagagcgtcacggagcaggacagcaaggactccacctacagcctctccagcaccctgaccctgtccaaggccgactacgagaagcacaaggtgtacgcctgcgaggtgacgcaccaggggctcagctcccccgtcaccaagagcttcaaccgcggcgagtgc

SEQ ID NO: 12769 - RNA, 648 nt, synthetic construct; identical to SEQ ID NO: 8650
  misc_feature 1..648: note = derived and/or modified sequence opt1 from anti-influenza_Chain
  source 1..648: mol_type = other RNA

SEQ ID NO: 12770 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagccccggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagccggaggacttcgccgtgtactactgccagcactacagcaactggccgccccggctgaccttcggcgggggcaccaaggtcgagatcaagcgcacggtggccgccccctccgtgagcatcttcccgccctccgacgagcagctcaagagcgggaccgcgtccgtcgtgtgcctgctgaacaacttctacccccgggaggccaaggtgcagtggaaggtcgacaacgccctgcagagcggcaactcccaggagagcgtgaccgagcaggacagcaaggactccacctacagcctctccagcacgctgaccctgtccaaggccgactacgagaagcacaaggtgtacgcctgcgaggtcacccaccaggggctcagctcccccgtgaccaagagcttcaaccgcggcgagtgc

SEQ ID NO: 12771 - RNA, 648 nt, synthetic construct
  misc_feature 1..648: note = derived and/or modified sequence opt1 from anti-influenza_Chain
  source 1..648: mol_type = other RNA
gagatcgtgatgacccagagccccgccaccctgtccgtcagcccgggcgagcgcgccacgctctcctgccgggcgagccaggtgatctcccacaacctggcctggtaccagcagaagcccgggcaggcgccccgcctgctcatctacggcgccagcacccgggcctccgggatccccgcccgcttcagcggctccgggagcggcaccgactacaccctgacgatcacctccctgcagagcgaggacttcgccgtgtactactgccagcactactccaactggccgccccggctcaccttcggcgggggcaccaaggtcgagatcaagcgcacggtggccgcccccagcgtgttcatcttcccgccctccgacgagcagctcaagagcgggaccgcgtccgtcgtgtgcctgctgaacaacttctacccccgggaggccaaggtgcagtggaaggtcgacaacgccctgcagagcggcaactcccaggagagcgtgaccgagcaggacagcaaggactccacctacagcctgtccagcacgctcaccctgtccaaggccgactacgagaagcacaaggtgtacgcctgcgaggtcacccaccaggggctgagctcccccgtgaccaagagcttcaaccgcggcgagtgc

SEQ ID NO: 12772 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagagcgaggacttcgccgtgtactactgccagcactactccaacttcccgccccggctgaccttcggcgggggcaccaaggtcgagatcaagcgcacggtggccgcccccagcgtgttcatcttcccgccctccgacgagcagctcaagagcgggaccgcgtccgtcgtgtgcctgctgaacaacttctacccccgggaggccaaggtgcagtggaaggtcgacaacgccctgcagagcggcaactcccaggagagcgtgaccgagcaggacagcaaggactccacctacagcctctccagcacgctgaccctgtccaaggccgactacgagaagcacaaggtgtacgcctgcgaggtcacccaccaggggctcagctcccccgtgaccaagagcttcaaccgcggcgagtgc

SEQ ID NO: 12773 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagagcgaggacttcgccgtgtactactgccagcactactccaactacccgccccggctgaccttcggcgggggcaccaaggtcgagatcaagcgcacggtggccgcccccagcgtgttcatcttcccgccctccgacgagcagctcaagagcgggaccgcgtccgtcgtgtgcctgctgaacaacttctacccccgggaggccaaggtgcagtggaaggtcgacaacgccctgcagagcggcaactcccaggagagcgtgaccgagcaggacagcaaggactccacctacagcctctccagcacgctgaccctgtccaaggccgactacgagaagcacaaggtgtacgcctgcgaggtcacccaccaggggctcagctcccccgtgaccaagagcttcaaccgcggcgagtgc

SEQ ID NO: 12774 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccgccaccctctccgtcagcccgggcgagcgggtgacgctgtcctgccgggccagccagtccgtggcgaacaacctggcctggtaccagcagaagcccgggcagagcccccgcctcctgatctacggcgcctccacccgggacaccgggatccccgcccgcttcagcggctccgggagcggcaccgagttcacgctgaccatctccagcctccagtccgaggacttcgccgtctactactgccagcagtacaacaactggccgcccatgtacaccttcggccaggggaccaagctggagatcaagcggacggtggcggcccccagcgtgttcatcttcccgccctccgacgagcagctcaagagcggcaccgcctccgtcgtgtgcctgctgaacaacttctacccccgcgaggccaaggtgcagtggaaggtcgacaacgcgctgcagagcgggaactcccaggagagcgtgaccgagcaggacagcaaggactccacctacagcctctccagcacgctgaccctgtccaaggccgactacgagaagcacaaggtgtacgcctgcgaggtcacccaccagggcctcagctcccccgtgaccaagagcttcaaccgcggggagtgc

SEQ ID NO: 12775 - RNA, 648 nt, synthetic construct
  misc_feature 1..648: note = derived and/or modified sequence opt1 from anti-influenza_Chain
  source 1..648: mol_type = other RNA
gacatcgtgatgacccagagcccctccaccctgagcgcctccgtcggcgaccgcgtgacgatcacgtgccgggccagccagtccatcgggaactggctcgcgtggtaccagcagaagccgggcaaggcccccaagctgctgatctacaaggtgagcaccctcgagtccggggtccccagccgcttctccggcagcgggtccggcaccgagttcaccctgaccatcaacagcctgcagcccgacgacttcgccacctactactgccagcggtacacctccaacagccagggcttcacgttcgggcagggcaccaagctcgagatcaagcgcaccgtggccgccccgtccgtgttcatcttcccgcccagcgacgagcagctgaagtccgggaccgcgagcgtcgtgtgcctgctcaacaacttctacccccgggaggccaaggtgcagtggaaggtcgacaacgccctgcagtccggcaacagccaggagagcgtgacggagcaggactccaaggacagcacctactccctgagctccaccctcaccctgagcaaggccgactacgagaagcacaaggtgtacgcgtgcgaggtcacgcaccaggggctgtccagccccgtgaccaagtccttcaaccgcggcgagtgc

SEQ ID NO: 12776 - RNA, 648 nt, synthetic construct
  misc_feature 1..648: note = derived and/or modified sequence opt1 from anti-influenza_Chain
  source 1..648: mol_type = other RNA
gacatccagctgacccagagccccctctccccgcccgtgaccctgggccagcccgccagcatctcctgccgcagctcccagagcctgctctacacggacgggttcacctacctgtcctggtaccaccagcggcccggccagagcccgcgccggctgatctacaagatctccaaccgcgacagcggggtccccgaccggttctccggcagcgggtccggcaccgacttcaccctcaagatcagccgcgtggaggccgaggacgtgggcgtctactactgcatgcaggcgacgcactggcccctgaccttcggggagggcaccaaggtggagatcaagcccaaggccgccccgtccgtgaccctgttcccgcccagctccgaggagctccaggccaacaaggccacgctggtctgcctgatcagcgacttctaccccggggcggtgaccgtggcctggaaggccgactccagccccgtcaaggccggcgtggagaccaccacgcccagcaagcagtccaacaacaagtacgcggccagctcctacctcagcctgacccccgagcagtggaagtcccacaagagctactcctgccaggtgacccacgaggggagcaccgtcgagaagacggtggcccccaccgagtgctcc

SEQ ID NO: 12777 - RNA, 648 nt, synthetic construct
  misc_feature 1..648: note = derived and/or modified sequence opt1 from anti-influenza_Chain
  source 1..648: mol_type = other RNA
gagatcgtgctgacccagagccccggcaccctctccctgagcccgggggagcgggccacgctgtcctgccgggccagccagtccgtccgcagcaacaacctcgcgtggtaccagcacaagcccggccaggcgccccggctgctgatcttcggggcctccagccgcgccaccggcatccccgaccggttctccgggagcggctccggcaccgacttcaccctcacgatcagccgcctggagccggaggacttcgccgtgtactactgccagcagtacgggtccagccccgccctgaccttcggcgggggcaccaaggtggagatcaagcggaccgtcgccgccccctccgtgttcatcttcccgcccagcgacgagcagctcaagtccgggacggccagcgtggtctgcctgctgaacaacttctacccccgcgaggcgaaggtgcagtggaaggtggacaacgccctccagtccggcaacagccaggagagcgtcaccgagcaggactccaaggacagcacctactccctgagctccaccctgacgctcagcaaggccgactacgagaagcacaaggtgtacgcctgcgaggtgacccaccagggcctgtccagccccgtcaccaagtccttcaaccgcggggagtgc

SEQ ID NO: 12778 - RNA, 648 nt, synthetic construct
  misc_feature 1..648: note = derived and/or modified sequence opt1 from anti-influenza_Chain
  source 1..648: mol_type = other RNA
cagagcgtgctgacccagcccccgtccgccagcggctcccgcgggcagagcatcaccatctcctgcacgggcagcacctccgacatcgggagctacaactacgtctcctggtaccagcagcaccccggcaccgcccccaaggtgatcctctacgaggtgagccagcggccctccggggtcccggaccgcttcagcggctccaagagcggcaacaccgcgttcctgacggtgtccgggctgcagaccgacgacgaggccgactactactgcgccagctacgccggcaacaacatctacgtgttcgggtccggcaccaaggtcaccgtgctcgggcagcccaaggccaaccccacggtgaccctgttcccgcccagctccgaggagctgcaggcgaacaaggccaccctcgtctgcctgatcagcgacttctaccccggcgccgtgaccgtggcctggaaggcggacagctcccccgtcaaggccggcgtggagacgaccacccccagcaagcagtccaacaacaagtacgccgccagctcctacctgagcctcaccccggagcagtggaagtcccacaagagctactcctgccaggtgacgcacgaggggagcaccgtcgagaagaccgtggcccccaccgagtgctcc

SEQ ID NO: 12779 - RNA, 651 nt, synthetic construct
  misc_feature 1..651: note = derived and/or modified sequence opt1 from anti-influenza_Chain
  source 1..651: mol_type = other RNA
cagcccgtgctgacccagccgcccagcgcctccggcagccccgggcagcgcgtcaccatctcctgcagcggctccagctccaacatcgggagctacacggtgaactggtaccagcagctccccggcaccgccccgaagctgctgatctactccctcaaccagcggcccagcggggtgcccgaccgcttctccggcagcaagtccggcaccagcgcgtccctggccatcagcgggctgcagtccgaggacgaggccgtctactactgcgccgcctgggacgacagcctctccgcgcacgtggtgttcggcgggggcaccaagctgacggtcctggggcagcccaaggccgccccgagcgtgaccctcttcccgcccagctccgaggagctgcaggccaacaaggcgaccctggtgtgcctcatcagcgacttctaccccggcgccgtcaccgtggcctggaaggccgactccagccccgtgaaggccggcgtcgagacgaccaccccctccaagcagagcaacaacaagtacgcggcctccagctacctgtccctgacccccgagcagtggaagtcccaccggagctacagctgccaggtgacgcacgaggggtccaccgtggagaagaccgtcgcccccaccgagtgcagc

SEQ ID NO: 12780 - RNA, 651 nt, synthetic construct
  misc_feature 1..651: note = derived and/or modified sequence opt1 from anti-influenza_Chain
  source 1..651: mol_type = other RNA
cagcccgtgctgacccagccgcccagcgcctccggcacccccgggcagcgcgtcacgatcagctgctccggcagctccagcaacatcgggtccaacaccgtgagctggtaccagcaggtccccggcaccgccccgaagctcctgatctacgggaacaacgagcggccctccggcgtgcccgaccgcttcagcggctccaagagcgcgacctccgccagcctggccatctccgggctccagagcgaggacgaggccgactactactgcgccgcgtgggacgactccctgaacggcttctgggtgttcgggggcgggacgaagctgaccgtgctcggccagcccaaggccgccccgagcgtcaccctgttcccgccctccagcgaggagctgcaggccaacaaggcgaccctcgtgtgcctgatcagcgacttctaccccggcgccgtgacggtcgcctggaaggccgactccagccccgtgaaggccggggtggagaccaccaccccctccaagcagagcaacaacaagtacgcggcctccagctacctgtccctcacgcccgagcagtggaagtcccacaagagctacagctgccaggtcacccacgagggctccaccgtggagaagaccgtggcccccacggagtgcagc

SEQ ID NO: 12781 - RNA, 651 nt, synthetic construct
  misc_feature 1..651: note = derived and/or modified sequence opt1 from anti-influenza_Chain
  source 1..651: mol_type = other RNA
agctacgtgctgacccagcccccgtccgtcagcggcacccccgggcagcgcgtgatcatctcctgcagcggctactccagcaacatcgggtccaacacggtgaactggtaccagcagttccccggcaccgcgccccggctcctgatctacgccaacaaccagcgcccgcccggggtccccgaccggttcagcggctccaagagcggcacctccgccagcctggccatctccgggctccagagcgacgacgagtccgactactactgcgccgcctgggacgacagcctgaacggccactgggtgttcgggggcgggaccaagctgacggtgctcggccagcccaaggccgcgccgtccgtcaccctgttcccgcccagctccgaggagctgcaggccaacaaggccaccctcgtgtgcctgatcagcgacttctaccccggcgccgtgaccgtcgcgtggaaggccgacagctcccccgtgaaggccggggtggagacgaccacccccagcaagcagtccaacaacaagtacgccgccagctcctacctgagcctcacccccgagcagtggaagtcccaccgcagctactcctgccaggtcacgcacgagggcagcaccgtggagaagaccgtggcgcccaccgagtgctcc

SEQ ID NO: 12782 - RNA, 654 nt, synthetic construct
  misc_feature 1..654: note = derived and/or modified sequence opt1 from anti-influenza_Chain
  source 1..654: mol_type = other RNA
agctacgtgctgacccagcccccgtccgtcagcgtggcccccggccagaccgcccgcatcacgtgcgggggcaacaacatcgggtccaagagcgtgcactggtaccagcagaagcccggccaggcgcccgtcctcgtggtgtacgacgactccgaccggccgagcgggatccccgagcgcttctccggcagcaactccggcaacaccgccaccctgaccatcagccgggtcgaggccggggacgaggccgactactactgccaggtgtgggactccagctccgaccacgccgtgttcggcgggggcacgcagctgaccgtcctcggggcggccgccggccagcccaaggccgcgcccagcgtgaccctgttcccgccctccagcgaggagctgcaggccaacaaggccaccctcgtgtgcctgatctccgacttctaccccggcgccgtcacggtggcctggaaggcggacagctcccccgtgaaggccggggtcgagaccaccaccccgagcaagcagagcaacaacaagtacgccgcctccagctacctgtccctcacgcccgagcagtggaagtcccaccgcagctacagctgccaggtgacccacgagggctccaccgtggagaagaccgtcgcccccacggagtgcagc

SEQ ID NO: 12783 - RNA, 654 nt, synthetic construct
  misc_feature 1..654: note = derived and/or modified sequence opt1 from anti-influenza_Chain
  source 1..654: mol_type = other RNA
cagagcgtggtcacccagcccccgtccgtgagcgtggcccccggccagaccgcccgcatcacgtgcgggggcaacaacatcgggtccaagagcgtccactggtaccagcagaagcccggccaggcgcccgtgctggtggtctacgacgactccgaccggccgagcgggatccccgagcgcttctccggcagcaactccggcaacaccgccaccctcaccatcagccgggtggaggccggggacgaggccgactactactgccaggtgtgggactccagctccgaccactacgtcttcggcacggggaccaaggtgaccgtgctgggcgccgcggccgggcagcccaaggccgcccccagcgtcaccctgttcccgccctccagcgaggagctccaggcgaacaaggccacgctggtgtgcctgatctccgacttctaccccggcgccgtgaccgtcgcctggaaggccgacagctcccccgtgaaggcgggcgtggagaccaccacgccgagcaagcagagcaacaacaagtacgccgcctccagctacctctccctgacccccgagcagtggaagtcccaccgcagctacagctgccaggtcacccacgaggggtccaccgtggagaagacggtggcccccaccgagtgcagc

SEQ ID NO: 12784 - RNA, 654 nt, synthetic construct
  misc_feature 1..654: note = derived and/or modified sequence opt1 from anti-influenza_Chain
  source 1..654: mol_type = other RNA
ctgagccgcatcaaccacttcgagaagatccagatcatccccaagtccagctggtccgaccacgaggccagctccggcgtgagctccgcctgcccgtaccaggggacccccagcttcttccggaacgtcgtgtggctcatcaagaagaacaacacctaccccacgatcaagcgctcctacaacaacaccaaccaggaggacctgctgatcctctggggcatccaccacagcaacgacgcggccgagcagaccaagctgtaccagaaccccaccacgtacatctccgtggggaccagcaccctgaaccagcggctcgtcccgaagatcgccacccgctccaaggtgaacggccagaacgggcggatggacttcttctggacgatcctgaagcccaacgacgccatcaacttcgagagcaacggcaacttcatcgcccccgagtacgcgtacaagatcgtgaagaagggcgactccgccatcgtcaagagcgaggtggagtacgggaactgcaacaccaagtgccagacccccatcggcgccatcaactccagcatgccgttccacaacatccaccccctgaccatcggggagtgccccaagtacgtgaagtccaacaagctcgtcctggccacgggcctgcgcaacagccccctc

SEQ ID NO: 12785 - RNA, 657 nt, synthetic construct
  misc_feature 1..657: note = derived and/or modified sequence opt1 from anti-influenza_Chain
  source 1..657: mol_type = other RNA
agctccgagctgacccagcccccgagcgcctccggcacccccgggcagcgggtgacgatcagctgctccggcagcacctccaacatcgggtacaaccccgtcagctggtaccagcaggtccccggcaccgccccgaagctcctgatctactccaacaccgagcggcccagcggggtgcccgaccgcttctccggcagcaagtccggcacgagcgcgtccctggccatcagcgggctccagtccgaggacgaggccgactactactgcgccgcctgggacgacaccctgaacggccccgtgttcgggggcgggaccaaggtgaccgtgctgggccagcggacggtcgcggccccgagcgtgttcatcttcccgccctccgacgagcagctcaagagcggcaccgccagcgtggtctgcctgctgaacaacttctacccccgcgaggccaaggtgcagtggaaggtggacaacgcgctccagtccgggaacagccaggagtccgtcaccgagcaggacagcaaggactccacctacagcctgtccagcacgctgaccctctccaaggccgactacgagaagcacaaggtgtacgcctgcgaggtgacccaccagggcctgagctcccccgtcaccaagagcttcaaccgcggggagtgc

SEQ ID NO: 12786 - RNA, 657 nt, synthetic construct; identical to SEQ ID NO: 8666
  misc_feature 1..657: note = derived and/or modified sequence opt1 from anti-influenza_Chain
  source 1..657: mol_type = other RNA

SEQ ID NO: 12787 - RNA, 660 nt, synthetic construct
  misc_feature 1..660: note = derived and/or modified sequence opt1 from anti-influenza_Chain
  source 1..660: mol_type = other RNA
agctacgtgctgacccagcccccgtccgccagcggcacccccgggcagcgcgtcacgatctcctgcagcggctccaccttcaacatcgggagcaacgccgtggactggtaccggcagctccccggcaccgcgcccaagctgctgatctactccaacaaccagcgcccgagcggggtgcccgaccggttctccggcagccgctccggcaccagcgcctccctcgccatcagcgggctgcagtccgaggacgaggccgactactactgcgccgcgtgggacgacatcctgaacgtccccgtgttcggcgggggcacgaagctcaccgtgctgggggccgccgccggccagcccaaggcggccccgagcgtcaccctgttcccgccctccagcgaggagctccaggccaacaaggccaccctggtgtgcctgatctccgacttctaccccggcgccgtgacggtcgcgtggaaggccgacagcagccccgtgaaggccggggtggagaccaccaccccctccaagcagagcaacaacaagtacgccgcctccagctacctctccctgacgcccgagcagtggaagtcccaccggagctacagctgccaggtcacccacgagggctccaccgtggagaagaccgtggcgcccacggagtgcagc

SEQ ID NO: 12788 - RNA, 660 nt, synthetic construct
  misc_feature 1..660: note = derived and/or modified sequence opt1 from anti-influenza_Chain
  source 1..660: mol_type = other RNA
cagagcgccctgacccagcccgccgcggtgtccggcagcccggggcagtccatcaccatcagctgcacgggcacctccagcgacgtcgggggctacaactacgtgtcctggtaccagcagcaccccgggaaggcccccaagctcatgatctacgaggtgagcaaccgcccctccggcgtcagcaaccggttctccggcagcaagtccgggaacaccgccagcctgaccatctccggcctgcaggccgaggacgaggccgactactactgcagctcctacacgagctccagcacctacgtgttcgggaccggcaccaaggtgacggtcctcggggcggccgccggccagccgaaggccgcgcccagcgtgaccctgttcccgccctccagcgaggagctgcaggccaacaaggccaccctcgtgtgcctgatctccgacttctaccccggcgccgtcaccgtggcctggaaggcggacagctcccccgtgaaggccggggtcgagacgaccacccccagcaagcagtccaacaacaagtacgccgccagctcctacctgagcctcacccccgagcagtggaagtcccaccgcagctactcctgccaggtgacgcacgagggcagcaccgtggagaagaccgtcgccccgaccgagtgctcc

SEQ ID NO: 12789 - RNA, 660 nt, synthetic construct
  misc_feature 1..660: note = derived and/or modified sequence opt1 from anti-influenza_Chain
  source 1..660: mol_type = other RNA
agctacgtgctgacccagcccccgtccgtcagcggcacccccgggcagcgcgtgacgatctcctgcagcggctcccggagcaacgtgggggacaactccgtctactggtaccagcacgtgcccgagatggcccccaagctcctggtgtacaagaacacccagcgcccgagcggcgtccccgcccggttctccgggagcaagtccggcaccagcgcgtccctggccatcatcggcctccagagcggggacgaggccgactactactgcgtggcctgggacgactccgtggacggctacgtcttcgggagcggcaccaaggtgacggtgctgggggccgcggccggccagcccaaggccgccccctccgtcaccctgttcccgcccagctccgaggagctccaggcgaacaaggccaccctggtgtgcctgatcagcgacttctaccccggcgccgtgaccgtcgcctggaaggccgacagctcccccgtgaaggcgggggtggagacgaccaccccgagcaagcagtccaacaacaagtacgccgccagctcctacctcagcctgacccccgagcagtggaagtcccaccgcagctactcctgccaggtcacgcacgagggcagcaccgtggagaagaccgtggcccccaccgagtgctcc

SEQ ID NO: 12790 - RNA, 660 nt, synthetic construct
  misc_feature 1..660: note = derived and/or modified sequence opt1 from anti-influenza_Chain
  source 1..660: mol_type = other RNA
agctacgtgctgacccagcccccgtccgccagcggcacccccgggcagcgcgtcacgatctcctgcagcggctccagctccaacatcgggagcaactacgtgtactggtaccagcagctccccggcaccgcccccaagctgctgatctaccgggacgggcagcgcccgtccggcgtgcccgaccggttcagcggctccaagagcgggacctccgcgagcctcgccatctccggcctgcgcagcgacgacgaggccgactactactgcgccacctgggacgacaacctgtccgggcccgtcttcggcgggggcacgaagctcaccgtgctgggcgccgcggccgggcagcccaaggccgccccgagcgtgaccctgttcccgccctccagcgaggagctccaggcgaacaaggccaccctggtctgcctgatcagcgacttctaccccggcgccgtgacggtggcctggaaggccgactccagccccgtcaaggcgggggtggagaccaccaccccctccaagcagagcaacaacaagtacgccgcctccagctacctctccctgacgcccgagcagtggaagtcccaccggagctacagctgccaggtgacccacgagggctccaccgtcgagaagaccgtggcccccacggagtgcagc

SEQ ID NO: 12791 - RNA, 660 nt, synthetic construct
  misc_feature 1..660: note = derived and/or modified sequence opt1 from anti-influenza_Chain
  source 1..660: mol_type = other RNA
cagagcgccctgacccagcccgcctccgtgagcggctccccggggcagagcatcaccatctcctgcacgggcaccagctccgacgtcgggggctacaactacgtgagctggtaccagcagcaccccgggaaggcgcccaagctcatgatctacgaggtgtccaaccgccccagcggcgtctccaaccggttcagcggctccaagagcgggaacaccgcctccctgaccatcagcggcctgcaggccgaggacgaggccgactactactgctccagctacacgtccagcagcaccctcgtgttcgggaccggcaccaaggtgacggtcctgggggccgcggccggccagccgaaggccgccccctccgtgaccctgttcccgcccagctccgaggagctccaggcgaacaaggccaccctggtgtgcctgatcagcgacttctaccccggcgccgtcaccgtggcctggaaggccgactccagccccgtgaaggcgggggtcgagacgaccaccccctccaagcagagcaacaacaagtacgccgcctccagctacctctccctgacccccgagcagtggaagtcccaccgcagctacagctgccaggtgacgcacgagggctccaccgtggagaagaccgtcgccccgaccgagtgcagc

SEQ ID NO: 12792 - RNA, 660 nt, synthetic construct
  misc_feature 1..660: note = derived and/or modified sequence opt1 from anti-influenza_Chain
  source 1..660: mol_type = other RNA
accgtgctgacccagcccccgagcgtctccggcgcccccgggcagcgcgtgacgatcagctgcaccggctccagctccaacatcggggccggctacgacgtgcactggtaccagcagctccccgggaccgcgcccaagctgctgatctacggcaacagcaaccggccgtccggcgtccccgaccgcttcagcgggtccaagagcggcacctccgccacgctcgggatcaccggcctgcagaccggggacgaggccgactactactgcggcacctgggacagctccctgagcgcctacgtgttcggcacggggaccaaggtgaccgtcctcggcgccgcggccgggcagcccaaggccgccccctccgtgaccctgttcccgcccagctccgaggagctgcaggcgaacaaggccacgctcgtgtgcctgatcagcgacttctaccccggcgccgtcaccgtggcctggaaggccgactccagccccgtgaaggcgggcgtcgagaccaccacgccgagcaagcagtccaacaacaagtacgccgccagctcctacctgagcctcacccccgagcagtggaagtcccaccggagctactcctgccaggtgacccacgaggggagcaccgtggagaagacggtcgcccccaccgagtgctcc

SEQ ID NO: 12793 - RNA, 663 nt, synthetic construct
  misc_feature 1..663: note = derived and/or modified sequence opt1 from anti-influenza_Chain
  source 1..663: mol_type = other RNA
cagagcgtgctgacccagcccccgtccgtcagcgccgcccccggccagaaggtgaccatctcctgcagcgggtccagctccaacatcggcaacgactacgtgagctggtaccagcagctccccgggacggcgcccaagctgctgatctacgacaacaacaagcgcccgtccggcatccccgaccggttcagcgggtccaagagcggcacctccgccaccctcggcatcaccgggctgcagacgggcgacgaggccaactactactgcgccacctgggaccgccggcccaccgcctacgtcgtgttcgggggcgggaccaagctgacggtgctcggcgcggccgccggccagcccaaggccgcgccgagcgtcaccctgttcccgccctccagcgaggagctgcaggccaacaaggccaccctcgtgtgcctgatctccgacttctaccccggggccgtgaccgtcgcctggaaggcggacagctcccccgtgaaggccggcgtggagacgaccacccccagcaagcagagcaacaacaagtacgccgcctccagctacctgtccctcacccccgagcagtggaagtcccaccgcagctacagctgccaggtcacgcacgaggggtccaccgtggagaagaccgtggcccccaccgagtgcagc

SEQ ID NO: 12794 - RNA, 675 nt, synthetic construct
  misc_feature 1..675: note = derived and/or modified sequence opt1 from anti-influenza_Chain
  source 1..675: mol_type = other RNA
atggtgggcttcacccccgtcgccctggccgcgctcgccgccaccggggccctggccttcccggcgggcaacgccacggagctggagaagcgccagaccacccccaacagcgaggggtggcacgacggctactactactcctggtggagcgacgggggcgcccaggccacctacacgaacctcgagggcgggacctacgagatctcctggggcgacgggggcaacctggtcgggggcaagggctggaaccccgggctgaacgcgcgggccatccacttcgagggcgtgtaccagcccaacgggaacagctacctcgccgtgtacggctggacccgcaacccgctggtggagtactacatcgtggagaacttcggcacctacgacccctccagcggggccacggacctgggcaccgtcgagtgcgacgggtccatctaccggctcggcaagaccacccgcgtgaacgcccccagcatcgacgggacgcagaccttcgaccagtactggtccgtgcggcaggacaagcgcaccagcggcaccgtccagacgggctgccacttcgacgcgtgggcccgggccgggctgaacgtgaacggcgaccactactaccagatcgtggccaccgaggggtacttctccagcggctacgcccgcatcaccgtcgcggacgtgggg

SEQ ID NO: 12795 - RNA, 687 nt, synthetic construct
  misc_feature 1..687: note = derived and/or modified sequence opt1 from anti-influenza_Chain
  source 1..687: mol_type = other RNA
cgcagcgacaagacccacacgtgcccgccctgccccgcccccgagctgctcggcgggccctccgtgttcctgttcccgcccaagcccaaggacaccctgatgatcagccggacccccgaggtgacctgcgtcgtggtcgacgtgtcccacgaggacccggaggtgaagttcaactggtacgtcgacggcgtggaggtgcacaacgccaagaccaagccccgcgaggagcagtacaacagcacgtaccgggtcgtgtccgtgctcaccgtcctgcaccaggactggctgaacgggaaggagtacaagtgcaaggtgagcaacaaggcgctccccgcccccatcgagaagaccatctccaaggccaagggccagccgcgcgagccccaggtgtacaccctgccgcccagccgggaggagatgacgaagaaccaggtctccctgacctgcctcgtgaaggggttctaccccagcgacatcgccgtggagtgggagtccaacggccagcccgagaacaactacaagaccaccccgcccgtcctggacagcgacggctccttcttcctgtacagcaagctcacggtggacaagtcccgctggcagcaggggaacgtgttcagctgctccgtcatgcacgaggccctgcacaaccactacacccagaagtccctgagcctcagccccggcaag

SEQ ID NO: 12796 - RNA, 696 nt, synthetic construct
  misc_feature 1..696: note = derived and/or modified sequence opt1 from anti-influenza_Chain
  source 1..696: mol_type = other RNA
cacgcccaggacatcctggagaagacccacaacggcaagctctgcgacctggacggggtgaagcccctgatcctccgcgactgcagcgtcgccggctggctgctggggaacccgatgtgcgacgagttcatcaacgtgcccgagtggtcctacatcgtggagaaggcgaaccccgccaacgacctctgctaccccggcaacttcaacgactacgaggagctgaagcacctcctgagccggatcaaccacttcgagaagatccagatcatcccgaagtccagctggtccgaccacgaggccagctccggggtcagctccgcctgcccctaccagggcacccccagcttcttccgcaacgtggtgtggctgatcaagaagaacaacacgtaccccaccatcaagcggtcctacaacaacaccaaccaggaggacctgctcatcctgtggggcatccaccacagcaacgacgccgcggagcagaccaagctgtaccagaacccgacgacctacatctccgtcgggaccagcaccctcaaccagcgcctggtgcccaagatcgccacgcggtccaaggtgaacggccagaacgggcgcatggacttcttctggaccatcctgaagcccaacgacgccatcaacttcgagagcaacggcaacttcatcgcccccgagtacgcgtacaagatcgtcaagaag

SEQ ID NO: 12797 - RNA, 699 nt, synthetic construct
  misc_feature 1..699: note = derived and/or modified sequence opt1 from anti-influenza_Chain
  source 1..699: mol_type = other RNA
atgcgccccagcatccagttcctgggcctcctgctgttctggctccacgggggccagtgcgacatccagatgacccagtccccgagctccctgagcgcctccctcgggggcaacgtgaccatcacgtgcaaggccagccaggacatcaacaagtacatcgcgtggtaccagcacaagcccgggaagggcccccggctggtcatccactacacctccaccctgcagcccggcatcccgagccgcttctccgggagcggctccgggaccgactacagcttctccatcagcaacctggagcccgaggacatcgccacgtactactgcctccagtacgacatcctgtacaccttcggcgggggcaccaagctggagatcaagcgggccgacgccgcccccaccgtgtccatcttcccgcccagctccgagcagctcacgagcggcggggcgtccgtggtctgcttcctgaacaacttctaccccaaggacatcaacgtgaagtggaagatcgacggcagcgagcgccagaacggggtgctgaacagctggaccgaccaggactccaaggacagcacctactccatgagctccaccctcacgctgaccaaggacgagtacgagcggcacaacagctacacgtgcgaggccacccacaagacctccaccagccccatcgtcaagtccttcaaccgcaacgagtgc

SEQ ID NO: 12798 - RNA, 702 nt, synthetic construct
  misc_feature 1..702: note = derived and/or modified sequence opt1 from anti-influenza_Chain
  source 1..702: mol_type = other RNA
atgatgagctccgcccagttcctgggcctcctgctgctctgcttccaggggacccgctgcgacatccagatgacccagacgagctccagcctgtccgccagcctgggcgaccgggtgaccatctcctgccgcgcgagccaggacatccggaactacctcaactggtaccagcagaagcccgacgggaccgtcaagctgctgatctactacacctcccgcctccacagcggcgtgccgtcccggttcagcgactccgggagcggcacggactactccctgaccatcagcaacctggagcaggaggacctcgccacctacttctgccagcagacctacacgctgccctggaccttcggcgggggcaccaagctggagatcaagcgcgccgacgccgcccccaccgtgtccatcttcccgcccagctccgagcagctcacgagcgggggcgcgagcgtcgtgtgcttcctgaacaacttctaccccaaggacatcaacgtgaagtggaagatcgacgggtccgagcggcagaacggcgtcctgaacagctggaccgaccaggactccaaggacagcacctactccatgagctccaccctcacgctgaccaaggacgagtacgagcgccacaacagctacacgtgcgaggccacccacaagacctccaccagccccatcgtgaagtccttcaaccggaacgagtgc

SEQ ID NO: 12799 - RNA, 702 nt, synthetic construct
  misc_feature 1..702: note = derived and/or modified sequence opt1 from anti-influenza_Chain
  source 1..702: mol_type = other RNA
atggaggcccccgcccagctcctgttcctgctgctcctgtggctgccggacaccaccggcgagatcgtgctcacgcagagccccgcgaccctgtccctgagccccggggagcgcgccaccctctcctgccgggccagcgagaacatctggaacaacctggcctggtaccagcagaagcccggccaggccccgcgcctgctcatctccggggcgagcaccggcgccacgggggtcccctcccggttccgcggcagcggctcccggaccgagttcaccctgaccatcagctccctgcagagcgaggacttcgccatctacttctgccagcagtacaactcctggccccgcacgttcgggcccggcaccaaggtggagatcaagcggaccgtggccgcgccgagcgtcttcatcttcccgccctccgacgagcagctcaagagcgggaccgcctccgtggtgtgcctgctgaacaacttctacccccgcgaggccaaggtccagtggaaggtggacaacgccctccagagcggcaactcccaggagagcgtgacggagcaggacagcaaggactccacctacagcctgtccagcaccctgaccctctccaaggccgactacgagaagcacaaggtctacgcgtgcgaggtgacgcaccaggggctgagctcccccgtgaccaagagcttcaaccggggcgagtgc

SEQ ID NO: 12800 - RNA, 705 nt, synthetic construct
  misc_feature 1..705: note = derived and/or modified sequence opt1 from anti-influenza_Chain
  source 1..705: mol_type = other RNA
atggagacccccgcccagctcctgttcctgctgctcctgtggctgccggacaccacgggcgagatcgtgctcacccagagccccgggaccctgtccctgagccccggcgagcgcgccaccctctcctgccgggcgagccagtccctgagctccagctccctggtctggtaccagcagaagcccgggcaggccccgcgcctcctgatctacggcgccagctcccgggccacggggatccccgaccgcttcagcggctccggcagcgggaccgacttcaccctgaccatctcccggctcgagcccgaggacttcgccgtgtactactgccagcagtacggcaacagcccctacacgttcgggcagggcacccaggtggagatcaagcgcaccgtcgcggccccgtccgtgttcatcttcccgcccagcgacgagcagctgaagtccgggaccgccagcgtggtctgcctgctcaacaacttctacccccgggaggccaaggtgcagtggaaggtggacaacgcgctgcagagcggcaactcccaggagagcgtcacggagcaggactccaaggacagcacctactccctgagctccaccctcaccctgagcaaggccgactacgagaagcacaaggtgtacgcctgcgaggtgacgcaccagggcctgtccagccccgtcaccaagtccttcaaccgcggggagtgc

SEQ ID NO: 12801 - RNA, 705 nt, synthetic construct
  misc_feature 1..705: note = derived and/or modified sequence opt1 from anti-influenza_Chain
  source 1..705: mol_type = other RNA
atggagacccccgcccagctcctgttcctgctgctcctgtggctgccggacaccacgggcgagaccgtgctcacccagagccccgggaccctgtccctgagccccggcgagcgcgccacgctctcctgccgggcgagccagtccgtcagcatctcctacctggcctggtaccagcgcaagcccgggcaggccccgcggctgctcatctacggcgccagccgccgggccaccgggatccccgaccgcttctccggcagcggctccgggaccgacttcaccctgacgatcagccggctggagcccgaggacttcgcggtgtactactgccagcagtacggctccagcccctacaccttcgggcagggcaccaagctcgagatcaagcgcaccgtggccgccccgtccgtcttcatcttcccgcccagcgacgagcagctgaagtccgggacggccagcgtggtgtgcctgctcaacaacttctacccccgggaggcgaaggtccagtggaaggtggacaacgccctgcagtccggcaacagccaggagagcgtgaccgagcaggactccaaggacagcacctactccctgagctccaccctcacgctgagcaaggccgactacgagaagcacaaggtctacgcctgcgaggtgacccaccagggcctgtccagccccgtgaccaagtccttcaaccgcggggagtgc

SEQ ID NO: 12802 - RNA, 705 nt, synthetic construct
  misc_feature 1..705: note = derived and/or modified sequence opt1 from anti-influenza_Chain
  source 1..705: mol_type = other RNA
atggcctggatgatgctgctcctgaccctgctcatccactgcaccggcagctgggcccagtccgtgctgacgcagcccccgagcgtctccgcggcccccgggcagaaggtgaccatcagctgctccggcagctccagcaacatcgggaagaactacgtgtcctggtaccagcagctgcccggcaccgcccccaagctcctgatctacgacaacgacaagcgcccgagcgggatccccgaccggttctccggcagcaagtccggcaccagcgccacgctggggatcaccggcctccagaccggggacgaggccgactaccactgcggcgcgtgggactccagcctgaacgggggcgtcttcggcgggggcaccaaggtgacggtgctggggcagcccaaggccgccccctccgtcaccctcttcccgcccagctccgaggagctgcaggccaacaaggcgaccctggtgtgcctcatcagcgacttctaccccggcgccgtgaccgtcgcctggaaggccgacagctcccccgtgaaggccggcgtggagacgaccaccccgagcaagcagtccaacaacaagtacgcggccagctcctacctgagcctgacccccgagcagtggaagtcccaccgcagctactcctgccaggtcacgcacgaggggagcaccgtggagaagaccgtggcccccaccgagtgctcc

SEQ ID NO: 12803 - RNA, 714 nt, synthetic construct
  misc_feature 1..714: note = derived and/or modified sequence opt1 from anti-influenza_Chain
  source 1..714: mol_type = other RNA
atgatgaagaagaagtcctggttcaccctgatgatcaccggcgtgatcagcctcttcttcagcgtctccgccttcgccgggaacgtgttctgggagcccctgagctacttcaactccagcacgtggcagaaggcggacggctactccaacgggcagatgttcaactgcacctggcgcgccaacaacgtgaacttcaccaacgacggcaagctgaagctcagcctgacctccccggccaacaacaagttcgactgcggggagtaccggagcacgaacaactacggctacggcctgtacgaggtctccatgaagcccgccaagaacaccgggatcgtgagctccttcttcacctacaccggccccagccacgggacgcagtgggacgagatcgacatcgagttcctcggcaaggacaccaccaaggtgcagttcaactactacaccaacggggtcggcggccacgagaagatcatcaacctggggttcgacgcctccacgagcttccacacctacgcgttcgactggcagcccggctacatcaagtggtacgtggacggggtgctgaagcacaccgccaccacgaacatcccgtccacccccggcaagatcatgatgaacctctggaacggcaccggggtcgacagctggctgggctcctacaacggggccaaccccctgtacgccgagtacgactgggtgaagtacaccagcaac

SEQ ID NO: 12804 - RNA, 729 nt, synthetic construct
  misc_feature 1..729: note = derived and/or modified sequence opt1 from anti-influenza_Chain
  source 1..729: mol_type = other RNA
caggtgcagctggtccagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatggggatgttcggcaccacgaactacgcccagaagttccaggggcgggtgaccatcaccgccgacgagttcaccagcgccgcgtacatggagctgcgctccctgcggagcgaggacacggccgtctactactgcgcccgctccagcggctactaccccgagtacttccaggactgggggcagggcaccctcgtgaccgtgtccagcggcaccgggggctccgggggcacgggcagcgggaccggcgggtccacccagagcgtcctgacccagccgccctccgagagcgtgagccccggccagacggcctccgtgacctgcagcgggcacaagctgggcgacaagtacgtctcctggtaccagcagaagcccggccagagccccgtgctcctgatctaccaggacaaccggcgcccctccgggatcccggagcggttcatcggcagcaactccgggaacaccgcgaccctgacgatcagcggcacccaggccctcgacgaggccgactactactgccaggcctgggactccagcaccgccgtgttcgggggcggcaccaagctgacggtcctgggg

SEQ ID NO: 12805 - RNA, 729 nt, synthetic construct
  misc_feature 1..729: note = derived and/or modified sequence opt1 from anti-influenza_Chain
  source 1..729: mol_type = other RNA
caggtgcagctggtccagagcggcgccgaggtgaagaagcccgggtccagcgtgaaggtctcctgcaaggccagcggcgggccgttccgcaacttcgcgatcaactgggtgcggcaggcccccggccaggggctcgagtggatgggcggcatcatcgccgtgttcgggaccaccaagtacgcccacaagttccagggccgcgtcacgatcaccgccgacgactccaccaacaccgcgtacatggagctggggagcctgaagtccgaggacacggccgtgtactactgcgcccggggcccccactactacagctcctacatggacgtgtggggcgaggggaccaccgtcaccgtgagctccggcaccgggggcagcgggggcaccggctccgggaccggcgggagcaccgacatccagctcacgcagtcccccagctccctgagcgcctccgtgggcgaccgcgtcaccatcacgtgccgggcgagccaggggatcagcacctacctggcctggtaccagcagaagccgggcaaggtgcccaagctcctgatctacgccgcctccacgctgcagagcggcgtgccctcccgcttcagcgggtccggcagcgggaccgacttcaccctcaccatctccagcctgcagcccgaggacgtcgccacgtactactgccagaagtacaactccgcgccgagcttcggccccgggaccaaggtggacatcaagcgg

SEQ ID NO: 12806 - RNA, 729 nt, synthetic construct
  misc_feature 1..729: note = derived and/or modified sequence opt1 from anti-influenza_Chain
  source 1..729: mol_type = other RNA
atgagctaccgcgtgaagcggatgctgatgctcctggtcaccggcctgttcctctccctgagcaccttcgccgcctccgcgagcgcccagaccgggggctccttctacgagcccttcaacaactacaacaccgggctgtggcagaaggccgacggctacagcaacgggaacatgttcaactgcacctggcgcgccaacaacgtgtccatgaccagcctcggcgagatgcggctgtccctgacgagcccgtcctacaacaagttcgactgcggcgagaaccgcagcgtgcagacctacgggtacggcctctacgaggtcaacatgaagcccgccaagaacgtggggatcgtgtccagcttcttcacctacaccggccccacggacgggaccccctgggacgagatcgacatcgagttcctgggcaaggacaccaccaaggtccagttcaactactacacgaacggcgtggggaaccacgagaagatcgtgaacctgggcttcgacgcggccaactcctaccacacctacgccttcgactggcagccgaacagcatcaagtggtacgtcgacgggcagctcaagcacaccgccaccacgcagatcccccagacccccggcaagatcatgatgaacctgtggaacggcgcgggggtggacgagtggctgggctcctacaacggggtgacgcccctcagccggtccctgcactgggtccgctacaccaagcgg

SEQ ID NO: 12807 - RNA, 735 nt, synthetic construct
  misc_feature 1..735: note = derived and/or modified sequence opt1 from anti-influenza_Chain
  source 1..735: mol_type = other RNA
caggtgcagctgcagcagagcggcgccgaggtcaagaagcccgggtccagcgtgaaggtgtcctgcaaggtcagcggcgtgatcttctccgggagcgccatctcctgggtgcgccaggcgccgggccaggggctcgagtggatgggcggcatcagccccctgttcgggaccaccaactacgcccagaagttccagggccgggtcacgatcaccgccgaccagtccaccaacaccacgtacatggaggtgaacagcctgcgctacgaggacaccgccgtgtacttctgcgcccgggggcccaagtactactccgagtacatggacgtctggggcaaggggaccaccgtgacggtgagctccggcaccggcgggagcggcgggaccggctccggcaccgggggcagcacggacatccagatgacccagtcccccagctccctcagcgcgagcgtcggggaccgcgtgaccatcacgtgccgggcctcccagggcatcagctcctacctggcctggtaccagcagaagccggggaaggtgcccaccctgctcatctacgacgccagcaccctgcgctccggcgtccccagccggttctccggcagcgggtccgcgaccgacttcaccctgacgatcagctccctccagcccgaggacgtggccacctactactgccagcgctacaacagcgccccgcccatcaccttcggccaggggacccggctggagatcaagcgc

SEQ ID NO: 12808 - RNA, 735 nt, synthetic construct
  misc_feature 1..735: note = derived and/or modified sequence opt1 from anti-influenza_Chain
  source 1..735: mol_type = other RNA
gaggtgcagctggtcgagagcggcgccgaggtgaagaagcccgggtccagcgtgaaggtctcctgcaaggccagcggcgggaccttctccagctacggcatctcctgggtgcgccaggccccggggcagggcctcgagtggatgggcgacatcatcgggatgttcggcagcaccaactacgcccagaacttccaggggcggctgacgatcaccgccgacgagtccaccagcaccgcctacatggagctgtccagcctccgctccgaggacacggccgtgtactactgcgcgcggagctccggctactaccccgcctacctgccccactgggggcagggcaccctggtcaccgtgagctccggcaccgggggcagcgggggcacgggctccgggaccggcgggagcaccgagatcgtgctcacccagagccccggcacgctgtccctgagcccgggggagcgcgccaccctctcctgccgggccagccagtccgtcagctccagctacctggcgtggtaccagcagaagcccggccaggcgccccgcctgctcatctacggcgcctccagccgggccaccgggatccccgaccgcttctccggcagcgggtccggcaccgacttcacgctgaccatcagccggctggagccggaggacttcgccgtgtactactgccagcagtacgggtccagcccccgcaccttcggcggcgggaccaaggtggagatcaagcgg

SEQ ID NO: 12809 - RNA, 735 nt, synthetic construct
  misc_feature 1..735: note = derived and/or modified sequence opt1 from anti-influenza_Chain
  source 1..735: mol_type = other RNA
gaggtgcagctggtcgagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatcgggatgttcggcaccgccaactacgcccagaagttccaggggcgggtgacgatcaccgccgacgagttcaccagcaccgcgtacatggagctgtccagcctgcgctccgaggacacggccgtctactactgcgcccggggcaactactactacgagagctccctcgactactgggggcagggcaccctggtgaccgtgagctccggcaccgggggcagcgggggcacgggctccgggaccggcgggagcacccagtccgtcgtgacccagccgcccagcgtgagcgtcgcccccggccagacggcgcgcatcacgtgcgggggcaacaacatcggctccaagagcgtgcactggtaccagcagaagcccgggcaggcccccgtgctggtcgtgtacgacgactccgaccggcccagcggcatccccgagcgcttctccgggagcaactccggcaacaccgccaccctcaccatcagccgggtggaggccggggacgaggccgactactactgccaggtctgggactccagctccgaccactacgtgttcggcaccggcaccaaggtgaccgtcctgggg

SEQ ID NO: 12810 - RNA, 735 nt, synthetic construct
  misc_feature 1..735: note = derived and/or modified sequence opt1 from anti-influenza_Chain
  source 1..735: mol_type = other RNA
gaggtgcagctggtccagagcggcgccgaggtgaagaagcccggggcctccgtgaaggtcagctgcaaggcgtccggctacaccttcaccgggtactacgtgtactgggtgcgccaggccccgggccaggggctcgagtggatgggctggatcagcgcctacaacggcaacacgaactacgcccagaagttccaggggcgggtcaccatcaccgccgacaagtccaccagcacggcgtacatggagctgtccagcctgcgctccgaggacaccgccgtgtactactgcgcccggagccgctccctcgacgtgtggggccaggggaccaccgtcacggtgagctccggcaccgggggcagcggcgggaccggctccgggaccggcggcagcacggacgtggtcatgacccagtcccccgacagcctggccgtgtccctgggggagcgggcgaccatcaactgcaagagcagccagtccgtgctctacagctccaacaacaagaactacctggcctggtaccagcagaagcccggccagcccccgaagctgctcatctactgggccagcacccgcgagtccggggtccccgaccggttcagcggctccgggagcggcacggacttcaccctgaccatctccagcctgcaggccgaggacgtggccgtgtactactgccagcagtactactccacgcccctcaccttcggcgggggcaccaaggtcgacatcaagcgc

SEQ ID NO: 12811 - RNA, 735 nt, synthetic construct
  misc_feature 1..735: note = derived and/or modified sequence opt1 from anti-influenza_Chain
  source 1..735: mol_type = other RNA
gaggtgcagctggtcgagaccggcgccgaggtgaagaagcccgggagctccgtgaaggtcccgtgcaagagctccggcagccccttccgctccaacgccgtgagctgggtgcggcaggcgcccgggcagggcctcgagtgggtcgggggcatcctgggcgtgttcgggtcccccagctacgcccagaagttccagggccgcgtgaccatcacggccgacgagtccaccaacaccgtccacatggagctgcgggggctccgcagcgaggacaccgccgtgtactactgcgcccggggcccgacgtactactactcctacatggacgtgtgggggaagggcaccaccgtcaccgtgagctccggcaccgggggcagcgggggcaccggctccgggaccggcgggagcacctcctacgtgctgacgcagccgcccagcgagtccgtcgcgcccggccagaccgcccgcatcacgtgcgggggcaacaacatcggccggaacagcgtgcactggtaccagcagaagcccgggcaggcccccgtgctggtcgtgtacgacgacagcgaccgcccctccggcatccccgagcggttcagcgggtccaagagcggcaacaccgccacgctcatcatctcccgcgtggaggtcggggacgaggcggactactactgccaggtgtggcacagctccagcgaccactacgtgttcggcaccggcaccaaggtcaccgtgctgggg

SEQ ID NO: 12812 - RNA, 735 nt, synthetic construct
  misc_feature 1..735: note = derived and/or modified sequence opt1 from anti-influenza_Chain
  source 1..735: mol_type = other RNA
cagatgcagctggtgcagagcggcgccgaggtcaagaagcccgggtccagcgtgaaggtgtcctgcaaggccagcggcgggaccttctccagctacgcgatctcctgggtccgccaggccccgggccaggggctcgagtggatgggcggcatcttcgggatgttcggcaccgccaactacgcccagaagttccaggggcgggtgacgatcaccgccgacgagttcaccagcgcggcctacatggagctgtccagcctgggctccgaggacaccgccatgtactactgcgcccgcagctccgggtactacccccagtacttccaggactggggccagggcacgctcgtgaccgtcagctccgggaccggcgggagcggcggcaccgggtccggcaccgggggcagcacggagatcgtgatgacccagtcccccgggaccctgagcctgagccccggccagcgggcgacgctctcctgccgcgccagccagtccgtgagctccagctacctggcctggtaccagcagaagccgggccaggcgccccggctgctcatgtacggggcctccagccgcgccaccggcatccccgaccggttctccgggagcggctccgggaccgacttcaccctgacgatcagccgcctggagcccgaggacttcgccgtctactactgccagcagtacggctccagctccctcaccttcggcgggggcaccaagctggagatcaagcgg

SEQ ID NO: 12813 - RNA, 735 nt, synthetic construct
  misc_feature 1..735: note = derived and/or modified sequence opt1 from anti-influenza_Chain
  source 1..735: mol_type = other RNA
caggtgcagctggtccagagcggcgccgaggtgaagaagcccgggtccagcgtgaaggtctcctgcaaggccagcggcgtgaccttctcctactacgcgatgagctgggtgcgccaggccccggggcagggcctcgagtggatgggcgggatctcccccatgttcggcaccacgacctacgcccagaagttccaggggcgggtcaccatcaccgccgacgacagcacgtccaccgcctacatggaggtgcgcagcctgcggtccgaggacaccgcggtgtactactgcgcccgcagctccaactactacgacagcgtctacgactactggggccaggggaccctggtgacggtgtccagcggcaccgggggctccggcgggaccggcagcgggaccggcggctccacgcagagcgtcgtgacccagccgcccagcgagtccgtggcccccgggcagaccgcccggatcacgtgcggcgggcacaacatcggcagcaactccgtccactggtaccagcagaagcccgggcaggcgcccgtgctcgtggtctacgacaacagcgaccgcccctccggcatcccggagcggttcagcggctccaacagcgggaacaccgccaccctgaccatctcccgcgtggaggccggcgacgaggccgactactactgccaggtgtgggggagctccagcgaccactacgtcttcggcaccgggacgaaggtgaccgtgctgggc

SEQ ID NO: 12814 - RNA, 738 nt, synthetic construct
  misc_feature 1..738: note = derived and/or modified sequence opt1 from anti-influenza_Chain
  source 1..738: mol_type = other RNA
caggtgcagctggtccagagcggcgggggcctcgtgaagcccgggggctccctgcgcctgagctgcgccgcctccgggttcaccttcagctcctacagcatgaactgggtgcggcaggcgccgggcaagggcctcgagtgggtctccagcatctccagctccagctcctacatctactacgtggacagcgtgaaggggcgcttcaccatctcccgggacaacgccaagaacagcctgtacctgcagatgaactccctccgcgccgaggacacggccgtctactactgcgcccggggcgggggcagctacggggcgtacgagggcttcgactactggggccaggggaccctggtgaccgtgtccagcggcaccgggggcagcggcgggacgggctccgggaccggcgggagcaccgagatcgtcctgacccagtcccccggcacgctcagcctgtcccccggcgagcgcgccaccctgagctgccgggcctcccagcgcgtgagctcctacctcgcctggtaccagcagaagcccgggcaggcgccgcggctgctgatctacggcgccagcacccgcgccgccgggatccccgaccggttctccggcagcgggtccggcaccgacttcacgctcaccatcagccgcctggagcccgaggactccgccgtgtactactgccagcagtacggccggacgcccctgaccttcgggggcgggaccaaggtcgagatcaagcgc

SEQ ID NO: 12815 - RNA, 738 nt, synthetic construct
  misc_feature 1..738: note = derived and/or modified sequence opt1 from anti-influenza_Chain
  source 1..738: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccggcaccgggggcagcgggggcaccggctccgggaccggcgggagcacctcctacgtgctgacgcagccgcccagcgtctccgtggcccccggccagaccgcccggatcacgtgcgggggcaacaacatcggcagcaagtccgtgcactggtaccagcagaagcccgggcaggcgcccgtcctcgtggtgtacgacgacagcgaccgccccagcggcatccccgagcggttctccgggagcaactccggcaacaccgccacgctgaccatcagccgcgtcgaggccggggacgaggccgactactactgccaggtgtgggactccagctccgaccacgccgtgttcggcggcgggacccagctgaccgtcctcggc

SEQ ID NO: 12816 - RNA, 738 nt, synthetic construct
  misc_feature 1..738: note = derived and/or modified sequence opt1 from anti-influenza_Chain
  source 1..738: mol_type = other RNA
gaggtgcagctggtcgagaccggcgccgaggtgaagaagcccggggccagcgtgaaggtctcctgcaaggcgagcggctacaccttcacgtcctactacatgcactgggtgcgccaggccccggggcagggcctcgagtggatggggtggatcaaccccaacagcggcggcaccaactacgcccagaagttccaggggcgggtgaccatgacccgcgacacgtccatcagcaccgcctacatggagctgtcccggctgcgcagcgacgacaccgccgtctactactgcgcgcgggagggcaagtgggggccccaggccgccttcgacatctggggccaggggaccatggtgacggtgtccagcggcaccggcgggtccggcgggaccggcagcggcaccgggggctccacggagatcgtcatgacccagagccccgggaccctctccctgagcccgggcgagcgcgccaccctgtcctgccgggcgagccagtccgtgagcagctcctacctcgcctggtaccagcagaagcccgggcaggcgccccgcctgctgatctacgacgccagctcccgggccacggacatccccgaccgcttcagcggctccggcagcgggaccgacttcaccctcaccatctcccggctggagccggaggacttcgccgtgtactactgccagcagtacggcagctccctgtggacgttcgggcagggcaccaaggtcgagatcaagcgc

SEQ ID NO: 12817 - RNA, 738 nt, synthetic construct
  misc_feature 1..738: note = derived and/or modified sequence opt1 from anti-influenza_Chain
  source 1..738: mol_type = other RNA
gaggtgcagctggtcgagagcggcgggggcctcgtgcagcccgggggctccctgcgcctgagctgcgccgcctccgggttcaccttcagcatctacgcgatgtcctgggtgcggcaggccccgggcaagggcctcgagtgggtcagcgccatctccagctccggggacagcacctactacgccgactccgtgaagggccgcttcacgatcagccgggacaacgcccgcaacaccctgtacctgcagatgaactccctccgggcggaggacaccgccgtgtactactgcgcccgcgcctacgggtacaccttcgacccctggggccaggggacgctggtcaccgtgagctccggcaccggcgggagcggcgggaccggctccggcaccgggggcagcaccgagatcgtgctgacccagagccccctctccctgcccgtcaccccgggggagcccgcgagcatctcctgccggagctcccagagcctgctccactccaacggctacaactacctggactggtacctgcagaagcccgggcagagcccccagctcctgatctacctgggctccaaccgcgccagcggcgtgccggaccggttctccgggagcggctccgggacggacttcaccctcaagatcagccgcgtggaggccgaggacgtcggcgtgtactactgcatgcaggccctgcagacgcccctgaccttcgggggcggcacgaaggtggagatcaagcgg

SEQ ID NO: 12818 - RNA, 738 nt, synthetic construct
  misc_feature 1..738: note = derived and/or modified sequence opt1 from anti-influenza_Chain
  source 1..738: mol_type = other RNA
gaggtgcagctggtcgagaccggcgccgaggtgaagaagcccgggagctccgtgaaggtcagctgcaaggcctccggcgggaccttccgcacgcacgcgatcagctgggtgcggcaggccccgggccaggggctcgagtggatgggcggcatcatcgccatcttcgggaccgccaactacgcccagaagttccagggccgcatcaccatcaccgcggacgagtccacgagcaccgcctacatggagctgtccagcctgcggtccgaggacaccgccgtgtacttctgcgcccgcgggagcggctaccacatctccacccccttcgacaactgggggcagggcacgctcgtcaccgtgagctccggcaccgggggcagcgggggcaccggctccgggacgggcgggagcacctcctacgtgctgacccagccgcccagcgtctccgtggcgcccggccagaccgcccggatcacgtgcgggggcaacaacatcggcagcaagggggtgcactggtaccagcagaagcccggccaggcccccgtcctggtggtgtacgacgacagcgaccgcccctccgggatcccggagcggttcagcggctccaacagcgggaacaccgccaccctcaccatctcccgcgtcgaggccggcgacgaggcggactactactgccaggtgtgggacagctccagcgaccacgtggtcttcggcgggggcacgaagctgaccgtgctgggg

SEQ ID NO: 12819 - RNA, 738 nt, synthetic construct
  misc_feature 1..738: note = derived and/or modified sequence opt1 from anti-influenza_Chain
  source 1..738: mol_type = other RNA
gaggtgcagctggtccagtccggcgccgaggtgaagaagcccgggtccagcgtgaaggtctcctgcaaggccagcggcgggatcttccgctccaacagcatctcctgggtgcggcaggcgccgggccaggggctcgagtggatgggcggcatcttcgccctgttcgggaccaccgactacgcccagaagttccagggccgcgtgacgatcaccgccgacgagagctccaccaccgtctacctggagctcagctccctgacgagcgaggacaccgccgtgtactactgcgcgcgggggtccggctacaccacccgcaactacttcgactactgggggcagggcacgctggtgaccgtcagctccggcaccgggggcagcgggggcaccggctccgggacgggcgggagcaccgagatcgtgctcacccagtcccccggcaccctgagcctgagccccggggagcgggccacgctctcctgccgcgccagccagtccgtgagctccaactacctgggctggtaccagcagaagcccggccaggccccgcggctgctcatctacggggcgagctcccgcgccagcggcatccccgaccggttctccgggggcgggagcggcaccgacttcaccctgaccatctcccgcctggagcccgaggacttcgccgtctactactgccagcagtacggcagcagccccctcacgttcgggggcgggaccaaggtggagatcaagcgg

SEQ ID NO: 12820 - RNA, 738 nt, synthetic construct
  misc_feature 1..738: note = derived and/or modified sequence opt1 from anti-influenza_Chain
  source 1..738: mol_type = other RNA
gaggtgcagctggtcgagagcggcgccgaggtgaagaagcccgggtccagcgtgaaggtctcctgcaaggccagcggcgggatcttcaactcctacgcgatcagctgggtgcgccaggccccgggccaggggctcgagtggatgggcggcatcatcgccatcttccacacccccaagtacgcccagaagttccaggggcgggtgaccatcacggccgacgagtccaccaacaccgcgtacatggagctgcgcagcctgaagtccgaggacaccgccctctactactgcgcccggggcagcacgtacgacttctccagcgggctggactactggggccaggggaccctggtcaccgtgtccagcggcaccggcgggtccggcgggacgggcagcggcaccgggggctccacccaggccgggctcacccagccgcccagcgtgtccgtcgcgcccggccagacggcccgcatcacgtgcgggggcaacaacatcggcagcaagagcgtgcactggtaccagcagaagcccgggcaggcccccgtgctggtcgtgtacgacgactccgaccggcccagcggcatcccggagcgcttctccgggagcaactccggcaacaccgccaccctgaccatcagccgggtggaggccggggacgaggcggactactactgccaggtctgggactccagctccgaccacgtggtgttcggcggcgggaccaagctcaccgtcctgggc

SEQ ID NO: 12821 - RNA, 741 nt, synthetic construct
  misc_feature 1..741: note = derived and/or modified sequence opt1 from anti-influenza_Chain
  source 1..741: mol_type = other RNA
cagatgcagctggtgcagagcggcgccgaggtcaagaagcccgggtccagcgtgaaggtgtcctgcaaggccagcggcgggaccttctccagctacgcgatcacctgggtccgccaggccccgggccaggggctcgagtggatgggcggcatcatcgggatgttcggctccacgaactacgcccagaacttccaggggcgggtgaccatcaccgccgacgagagcacctccacggcctacatggagctgagctccctgcgcagcgaggacaccgcggtgtactactgcgcccggtccaccggctactaccccgcctacctccaccactgggggcagggcaccctggtcacggtgagctccggcaccgggggcagcgggggcaccggctccgggaccggcgggagcacgcagtccgccctgacccagccccgcagcgtgagcggctcccccgggcagagcgtcaccatctcctgcaccggcacgagctccgacgtgggcgggtacaactacgtgagctggtaccagcagcacccgggcaaggcgcccaagctcatgatctacgacgtctccaagcggcccagcggggtgcccgaccgcttctccggcagcaagtccgggaacaccgccagcctgaccatctccggcctgcaggccgaggacgaggccgactactactgcagctcctacaccagctccagcacgcacgtgttcggcaccgggaccaaggtcaccgtgctcggc

SEQ ID NO: 12822 - RNA, 744 nt, synthetic construct
  misc_feature 1..744: note = derived and/or modified sequence opt1 from anti-influenza_Chain
  source 1..744: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccggcaccgggggcagcgggggcacgggctccgggaccggcgggagcacctcctacgtgctgacgcagccgcccagcgcctccggcacccccgggcagcgggtcaccatcagctgctccggcagcaccttcaacatcggcagcaacgccgtggactggtaccgccagctccccgggacggcgcccaagctgctgatctactccaacaaccagcggcccagcggcgtgcccgaccgcttctccgggagccggtccggcaccagcgcctccctcgccatcagcgggctgcagtccgaggacgaggccgactactactgcgccgcgtgggacgacatcctgaacgtcccggtgttcggcggcgggaccaagctcaccgtgctgggc

SEQ ID NO: 12823 - RNA, 744 nt, synthetic construct
  misc_feature 1..744: note = derived and/or modified sequence opt1 from anti-influenza_Chain
  source 1..744: mol_type = other RNA
caggtgcagctggtccagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccggcaccgggggcagcgggggcacgggctccgggaccggcgggagcacccagtccgccctgacgcagcccgccgcggtgagcggctcccccgggcagagcatcaccatctcctgcaccggcaccagcagcgacgtcggcgggtacaactacgtgtcctggtaccagcagcaccccggcaaggccccgaagctcatgatctacgaggtgagcaaccggccctccggggtcagcaaccgcttctccggcagcaagtccgggaacacggccagcctgaccatctccggcctgcaggccgaggacgaggccgactactactgcagctcctacaccagctccagcacctacgtgttcggcacggggaccaaggtgaccgtcctcggc

SEQ ID NO: 12824 - RNA, 744 nt, synthetic construct
  misc_feature 1..744: note = derived and/or modified sequence opt1 from anti-influenza_Chain
  source 1..744: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccggcaccgggggcagcgggggcacgggctccgggaccggcgggagcacctcctacgtgctgacgcagccgcccagcgtctccggcacccccgggcagcgggtgaccatcagctgctccggcagccgcagcaacgtgggcgacaactccgtctactggtaccagcacgtgcccgagatggcccccaagctcctggtgtacaagaacacccagcggcccagcggggtccccgcccgcttctccggcagcaagtccgggacgagcgcgtccctggccatcatcggcctccagagcggggacgaggccgactactactgcgtggcctgggacgactccgtggacggctacgtcttcggcagcgggaccaaggtgaccgtgctgggc

SEQ ID NO: 12825 - RNA, 744 nt, synthetic construct
  misc_feature 1..744: note = derived and/or modified sequence opt1 from anti-influenza_Chain
  source 1..744: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccggcaccgggggcagcgggggcacgggctccgggaccggcgggagcacctcctacgtgctgacgcagccgcccagcgcctccggcacccccgggcagcgggtcaccatcagctgctccggcagcagctccaacatcggcagcaactacgtgtactggtaccagcagctccccgggaccgcccccaagctgctgatctaccgcgacggccagcggccctccggggtgcccgaccgcttcagcggctccaagagcgggacgtccgcgagcctcgccatctccggcctgcggagcgacgacgaggccgactactactgcgccacctgggacgacaacctgtccggcccggtcttcgggggcgggaccaagctcaccgtgctgggc

SEQ ID NO: 12826 - RNA, 744 nt, synthetic construct
  misc_feature 1..744: note = derived and/or modified sequence opt1 from anti-influenza_Chain
  source 1..744: mol_type = other RNA
gaggtgcagctggtcgagagcggcgccgaggtgaagaagcccgggtccagcgtgaaggtctcctgcaaggccagcggcgggaccttctccttctacagcatgtcctgggtgcgccaggcgccgggccaggggctcgagtggatgggcggcatcatccccatgttcgggaccacgaactacgcccagaagttccagggccgggtgaccatcaccgccgtcgagagcacctccacggcctacatggaggtgagctccctgcgcagcgaggacaccgccgtgtactactgcgcgcgcggggacaagggcatctactactactacatggacgtctgggggaagggcaccaccgtgacggtgtccagcggcaccgggggctccgggggcaccggcagcgggaccggcgggtccacgcagagcgccctgacccagcccgcctccgtcagcggcagccccgggcagtccatcaccatcagctgcaccggcacgtccagcgacgtgggcgggtacaactacgtgtcctggtaccagcagcacccgggcaaggcccccaagctcatgatctacgaggtcagcaaccggccctccggggtgagcaaccggttctccggcagcaagtccgggaacaccgcgagcctgaccatctccggcctgcaggccgaggacgaggccgactactactgcagctcctacaccagctccagcacgctcgtgttcggcaccgggaccaaggtcaccgtgctgggc

SEQ ID NO: 12827 - RNA, 744 nt, synthetic construct
  misc_feature 1..744: note = derived and/or modified sequence opt1 from anti-influenza_Chain
  source 1..744: mol_type = other RNA
atgagcctgttcggcgacaccatcgcctacctcctgtccctgatcgaggacggggagggcaaggccgagctcgcggagaagctgcactgctggttcgggggcaaggagttcgacctggacagcgccctcgagtggatcaagaacaagcgctgcctgaccgacatccagaaggccctgatcggggcctccatctgcttcctcaagcccaaggaccaggagcggaagcgccggttcatcacggagccgctgagcggcatgggcaccaccgccaccaagaagaaggggctgatcctcgcggagcgcaagatgcggcgctgcgtgtccttccacgaggccttcgagatcgccgagggccacgagagctccgccctgctgtactgcctcatggtcatgtacctgaaccccgagaactacagcatgcaggtcaagctggggacgctctgcgcgctgtgcgagaagcaggcctcccacagccaccgggcccactcccgcgccgcccggagctccgtgcccggcgtgcgccgggagatgcagatggtgagcgcgatgaacaccgccaagaccatgaacgggatgggcaagggcgaggacgtgcagaagctggccgaggagctccagaacaacatcggggtcctgcgctccctgggcgccagccagaagaacggggagggcatcgccaaggacgtgatggaggtgctcaagcagtccagcatgggcaactccgcgctggtccggaagtacctg

SEQ ID NO: 12828 - RNA, 747 nt, synthetic construct
  misc_feature 1..747: note = derived and/or modified sequence opt1 from anti-influenza_Chain
  source 1..747: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccggcaccgggggcagcgggggcacgggctccgggaccggcgggagcacccagtccgtgctgacgcagccgcccagcgtctccgccgcccccggccagaaggtgaccatcagctgctccgggagcagctccaacatcggcaacgactacgtgagctggtaccagcagctccccggcaccgcgcccaagctgctgatctacgacaacaacaagcggccctccgggatccccgaccgcttcagcggctccaagagcgggacctccgccacgctcggcatcaccgggctgcagaccggcgacgaggccaactactactgcgccacctgggaccggcgcccgacggcctacgtcgtgttcggcgggggcaccaagctgaccgtgctcggg

SEQ ID NO: 12829 - RNA, 750 nt, synthetic construct
  misc_feature 1..750: note = derived and/or modified sequence opt1 from anti-influenza_Chain
  source 1..750: mol_type = other RNA
caggtgcagctggtccagagcggcgccgaggtgaagaagcccgggtccagcgtgcgcgtctcctgcaaggccagcggctccatcttccggaactacgcgatgagctgggtgcgccaggccccggggcagggcctcgagtggatgggcgggatcatcgccatcttcggcacccccaagtacgcccagaagttccaggggcgggtgaccatcacggccgacgagtccaccagcaccgtctacatggagctgtccggcctgcgcagcgaggacaccgcgatgtactactgcgcccggatcccccactacaacttcgggtccggcagctacttcgactactgggggcagggcacgctcgtgaccgtgtccagcggcaccgggggctccgggggcaccggcagcgggacgggcgggtccaccaccgtcctgacccagcccccgagcgtgtccggcgcccccgggcagcgcgtgacgatcagctgcaccggcagctccagcaacatcggcgccgggtacgacgtccactggtaccagcagctgcccggcaccgcgcccaagctcctgatctacgggaactccaaccggccgagcggcgtgcccgaccgcttctccgggagcaagtccggcaccagcgccacgctgggcatcaccgggctccagaccggcgacgaggccgactactactgcgggacctgggactccagcctgtccgcctacgtgttcggcacggggaccaaggtcaccgtgctgggc

SEQ ID NO: 12830 - RNA, 756 nt, synthetic construct
  misc_feature 1..756: note = derived and/or modified sequence opt1 from anti-influenza_Chain
  source 1..756: mol_type = other RNA
gaggtgcagctggtcgagagcggcgccgaggtgaagaagcccgggtccagcgtgaaggtctcctgcaaggccagcggccacatcttctccgggtacgccatcagctgggtgcgccaggccccgggccaggggctcgagtggatgggcggcatcatccccatcttcgggaccaccaactacgcccagaagttccagggccgggtgacgatcaccgccgaccagtccaccagcaccgcctacatggacctgtccaacctgcgcagcgaggacacggcggtctactactgcgcccgggtgaaggacgggtactgcaccctcacctcctgccccgtgggctggtacttcgacctgtgggggcgcggcaccctggtcacggtgagctccggcaccgggggcagcgggggcaccggctccgggaccggcgggagcacggagatcgtgatgacccagtcccccggcaccctcagcctgtccccgggggagcgggccaccctgagctgccgcgccagccagtccgtcagctccagctacctcgcgtggtaccagcagaagcccggccaggcgccccggctgctgatcttcggcgcctccagccgcgccacggggatccccgaccggttctccggcagcgggtccggcaccgacttcaccctcaccatcagccgcctggagccggaggacttcgccgtgtactactgccagcagtacgggtccagcctgacgttcggcggcgggaccaagctcgagatcaagcgg

SEQ ID NO: 12831 - RNA, 768 nt, synthetic construct
  misc_feature 1..768: note = derived and/or modified sequence opt1 from anti-influenza_Chain
  source 1..768: mol_type = other RNA
caggtgcagctggtccagagcggcgccgaggtgaagaagcccgggtccagcgtgaaggtctcctgcaaggccagcggcgggttcttctccagctacgcgatctcctgggtgcgccaggcccccggccaggggctcgagtggatgggcggcgtgatccccatcttccggaccgccaactacgcccagaacttccaggggcgcgtcaccatcacggccgacgagttcaccagctacatggagctgtccagcctgcggtccgacgacaccgcggtgtactactgcgcccgcctcaactaccacgacagcggcacctactacaacgcgccccgggggtggttcgacccctggggccaggggacgctggtgaccgtctccagcggcaccggcgggtccggcgggaccggcagcggcaccgggggctccacggacatccagatgacccagagcccggactccctggccgtgagcctcggggagaaggccaccatcaactgcaagagctcccagagcatcctgaactccagcaacaacaagaactacctggcctggtaccagcagaagcccggccagccgcccaagctcctgatctactgggcctccacgcgcgagagcggggtgcccgaccggttctccggcagcggctccgggaccgacttcaccctgaccatcagctccctccaggccgaggacgtcgccgtgtactactgccagcagtactacagctccccgcccacgttcggccaggggaccaaggtggagatcaagcgc

SEQ ID NO: 12832 - RNA, 768 nt, synthetic construct; identical to SEQ ID NO: 12831
  misc_feature 1..768: note = derived and/or modified sequence opt1 from anti-influenza_Chain
  source 1..768: mol_type = other RNA

SEQ ID NO: 12833 - RNA, 771 nt, synthetic construct
  misc_feature 1..771: note = derived and/or modified sequence opt1 from anti-influenza_Chain
  source 1..771: mol_type = other RNA
atctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctgtcccggatcaaccacttcgagaagatccagatcatccccaagagctcctggagcgaccacgaggcctccagcggcgtctccagcgcctgcccgtaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagaacggccgcatggacttcttctggaccatcctgaagcccaacgacgccatcaacttcgagtccaacgggaacttcatcgcgcccgagtacgcctacaagatcgtcaagaag

SEQ ID NO: 12834 - RNA, 771 nt, synthetic construct; identical to SEQ ID NO: 12833
  misc_feature 1..771: note = derived and/or modified sequence opt1 from anti-influenza_Chain
  source 1..771: mol_type = other RNA

SEQ ID NO: 12835 - RNA, 777 nt, synthetic construct
  misc_feature 1..777: note = derived and/or modified sequence opt1 from anti-influenza_Chain
  source 1..777: mol_type = other RNA
atggtcaagagcaagtacctggtgttcatctccgtgttcagcctcctgttcggcgtgttcgtcgtggggttctcccaccagggcgtgaaggccgaggaggagcgccccatggggaccgccttctacgagagcttcgacgcgttcgacgacgagcggtggtccaaggccggcgtctggaccaacgggcagatgttcaacgccacctggtacccggagcaggtcaccgccgacggcctgatgcgcctcaccatcgccaagaagaccacgagcgcgcggaactacaaggccggcgagctgcgcaccaacgacttctaccactacgggctgttcgaggtgtccatgaagcccgccaaggtggagggcaccgtgagctccttcttcacctacacgggggagtgggactgggacggcgacccctgggacgagatcgacatcgagttcctcgggaaggacaccacccggatccagttcaactacttcaccaacggcgtgggcgggaacgagttctactacgacctgggcttcgacgccagcgagtccttcaacacgtacgcgttcgagtggcgcgaggacagcatcacctggtacgtcaacggggaggccgtgcacaccgccaccgagaacatcccccagacgccgcagaagatcatgatgaacctgtggcccggcgtgggcgtcgacgggtggaccggcgtgttcgacggggacaacacccccgtgtactcctactacgactgggtccggtacacgcccctccagaactaccagatccaccag

SEQ ID NO: 12836 - RNA, 777 nt, synthetic construct; identical to SEQ ID NO: 12835
  misc_feature 1..777: note = derived and/or modified sequence opt1 from anti-influenza_Chain
  source 1..777: mol_type = other RNA

SEQ ID NO: 12837 - RNA, 783 nt, synthetic construct
  misc_feature 1..783: note = derived and/or modified sequence opt1 from anti-influenza_Chain
  source 1..783: mol_type = other RNA
gacatccagatgacccagagcccctccagcgtgtccgccagcgtcggcgaccgcgtgaccatcacgtgccgggcctcccaggacatcagcacctggctggcgtggtaccagcagaagccggggaaggcccccaagctcctgatctacgccgcctccagcctgcagtccggcgtgcccagccgcttctccgggagcggctccgggaccgacttcaccctcacgatcagctccctgcagcccgaggacttcgccacctacttctgccagcaggcgaacagcttcccgcccaccttcggctgcggcaccaagctggagatcaagggcgggggcgggtccgggggcggcgggagcggcgggggcggctccgggggcgggggcagcgaggtccagctcgtggtgagcgggggcggcctggtcaagcccgggggctccctgcggctcagctgcgccgcctccgggctgagcttcctgaacgcctggatgtcctgggtgcgccaggcgcccggcaagtgcctcgagtgggtggggcggatcaagagcaacacggacggcggcaccaccgactacgccgccccggtcaaggggcgcttctccatcagccgggacgactccaagaacatgctgttcctgcacatgagctccctccgcaccgaggacacggccgtgtactactgcgccaccgacggcccctacagcgacgacttccggtccgggtacgcggcccgctaccggtacttcggcatggacgtgtgggggcagggcaccaccgtcacggtgagctcc

SEQ ID NO: 12838 - RNA, 783 nt, synthetic construct; identical to SEQ ID NO: 12837
  misc_feature 1..783: note = derived and/or modified sequence opt1 from anti-influenza_Chain
  source 1..783: mol_type = other RNA

SEQ ID NO: 12839 - RNA, 789 nt, synthetic construct
  misc_feature 1..789: note = derived and/or modified sequence opt1 from anti-influenza_Chain
  source 1..789: mol_type = other RNA
atgggcttcgtgctgttcagccagctcccctccttcctgctggtcagcaccctcctgctgttcctcgtgatctcccacagctgccgcgcccagaacgggggctcctacccgtacaagagcggggagtaccggaccaagtccttcttcggctacgggtactacgaggtgcgcatgaaggccgcgaagaacgtcggcatcgtgagctccttcttcacgtacaccggccccagcgacaacaacccctgggacgagatcgacatcgagttcctggggaaggacaccaccaaggtgcagttcaactggtacaagaacggcgtcgggggcaacgagtacctgcacaacctcgggttcgacgcctcccaggacttccacacgtacggcttcgagtggcggcccgactacatcgacttctacgtggacggcaagaaggtgtaccgcgggacccggaacatcccggtcacccccggcaagatcatgatgaacctgtggcccgggatcggcgtggacgagtggctgggccgctacgacgggcggacgcccctccaggccgagtacgagtacgtgaagtactacccgaacggccgcagcaagctggtcgtgaacacccccttcgtggccgtcttctccaacttcgacagctcccagtgggagaaggccgactgggcgaacgggagcgtgttcaactgcgtgtggaagccctcccaggtcaccttcagcaacggcaagatgatcctgaccctcgaccgggagtacgtggaccaccaccaccaccaccacaaggacgagctg

SEQ ID NO: 12840 - RNA, 789 nt, synthetic construct; identical to SEQ ID NO: 12839
  misc_feature 1..789: note = derived and/or modified sequence opt1 from anti-influenza_Chain
  source 1..789: mol_type = other RNA

SEQ ID NO: 12841 - RNA, 840 nt, synthetic construct
  misc_feature 1..840: note = derived and/or modified sequence opt1 from anti-influenza_Chain
  source 1..840: mol_type = other RNA
atggcccaggtgggccgcggggccagccccctgtcccgggcgcgcgtcccgcccctcccccaccccctggacggcgagcacctcccgcacgaccccgccgggggcgggcacggcaaggccagctcccaggacgcccccgtgggccagctccccgggcacctggcccggccggcgttcttccactacctgaagaacagcttcctcgtgtgctccctgaccaccgtcttcgccctggccgtggccacgttcgcgggctacgccctcgcccgcttccggttccccggggccgagctgttcggcgggagcgtgctggtcacccaggtgatccccggcatcctcttcctgatccccatctacatcatgtacatctacgtgcagaactgggtccgctccgccctgggcctcgaggtgcggctggtggggagctacggcgggctggtcttcacctacaccgcgttcttcgtgccgctctccatctggatcctgcgcggcttcttcgccagcatccccaaggagctggaggaggccgccatggtggacggcgccacgcccttccaggcgttccaccgggtcatcctccccctggccctgccggggctcgccgccaccgccgtgtacatcttcctgaccgcgtgggacgagctgctgttcgcccaggtgctgaccacggaggccaccgccaccgtccccgtgggcatccgcaacttcgtggggaactaccagaaccggtacgacctggtcatggccgcggccaccgtggccacgctccccgtgctggtcctgttcttcttcgtgcagcgccagctcatccagggcctgaccgccggggcggtcaagggc

SEQ ID NO: 12842 - RNA, 840 nt, synthetic construct; identical to SEQ ID NO: 12841
  misc_feature 1..840: note = derived and/or modified sequence opt1 from anti-influenza_Chain
  source 1..840: mol_type = other RNA

SEQ ID NO: 12843 - RNA, 843 nt, synthetic construct
  misc_feature 1..843: note = derived and/or modified sequence opt1 from anti-influenza_Chain
  source 1..843: mol_type = other RNA
atggccgacaacatgaccaccacgcagatcgaggtgggccccggggccaccaacgcgaccatcaacttcgaggccggcatcctggagtgctacgagcgcttcagctggcagcgggccctcgactacccggggcaggaccgcctgcaccggctgaagcgcaagctcgagtcccggatcaagacccacaacaagagcgagcccgagaacaagcgcatgtccctggaggagcggaaggccatcggcgtcaagatgatgaaggtgctcctgttcatggaccccagcgccgggatcgagggcttcgagccctactgcgtgaagaacccgtccacgagcaagtgccccaactacgactggaccgactacccgcccacccccggcaagtacctggacgacatcgaggaggagcccgagaacgtcgaccaccccatcgaggtggtgctgcgcgacatgaacaacaaggacgcgcggcagaagatcaaggacgaggtcaacacccagaaggaggggaagttccgcctcacgatcaagcgggacatccgcaacgtgctgtccctgcgggtgctcgtcaacggcaccttcctgaagcaccccaacggggacaagagcctgtccaccctccaccgcctgaacgcctacgaccagaacggcgggctggtggccaagctcgtggccaccgacgaccggacggtcgaggacgagaaggacggccaccgcatcctgaacagcctgttcgagcggttcgacgagggccactccaagccgatccgcgcggccgagaccgccgtgggggtgctcagccagttcggccaggagcaccggctgtcccccgaggagggggacaac

SEQ ID NO: 12844 - RNA, 843 nt, synthetic construct; identical to SEQ ID NO: 12843
  misc_feature 1..843: note = derived and/or modified sequence opt1 from anti-influenza_Chain
  source 1..843: mol_type = other RNA

SEQ ID NO: 12845 - RNA, 858 nt, synthetic construct
  misc_feature 1..858: note = derived and/or modified sequence opt1 from anti-influenza_Chain
  source 1..858: mol_type = other RNA
atgtgcaccatgcccctgatgaagctcaagaagatgatgcgccggaccgccttcctgctgagcgtgctcatcggctgctccatgctggggagcgaccgctccgacaaggccccgcactgggagctggtctggagcgacgagttcgactactccggcctccccgaccccgagaagtgggactacgacgtcgggggccacgggtggggcaaccaggagctgcagtactacacgcgggcgcgcatcgagaacgcccgggtgggcgggggcgtgctgatcatcgaggcccgccacgagccctacgaggggcgggagtacaccagcgcccgcctcgtgacccggggcaaggcctcctggacctacgggcgcttcgagatccgggcgcgcctgccgagcggccggggcacgtggcccgccatctggatgctgcccgaccgccagacctacgggtccgcctactggcccgacaacggcgagatcgacatcatggagcacgtggggttcaacccggacgtcgtgcacggcaccgtgcacaccaaggcctacaaccacctcctgggcacgcagcgcgggggcagcatccgggtccccaccgcgcggaccgacttccacgtgtacgccatcgagtggacccccgaggagatccgctggttcgtggacgactccctgtactaccggttccccaacgagcgcctcacggacccggaggccgactggcggcactggcccttcgaccagcccttccacctgatcatgaacatcgccgtcgggggcgcctggggcgggcagcagggcgtggaccccgaggcgttcccggcccagctggtggtcgactacgtgcgcgtgtaccgctgggtcgag

SEQ ID NO: 12846 - RNA, 858 nt, synthetic construct; identical to SEQ ID NO: 12845
  misc_feature 1..858: note = derived and/or modified sequence opt1 from anti-influenza_Chain
  source 1..858: mol_type = other RNA

SEQ ID NO: 12847 - RNA, 900 nt, synthetic construct
  misc_feature 1..900: note = derived and/or modified sequence opt1 from anti-influenza_Chain
  source 1..900: mol_type = other RNA
aacgtgcccgagtggagctacatcgtcgagaaggccaacccggccaacgacctgtgctaccccggcaacttcaacgactacgaggagctcaagcacctcctgtcccgcatcaaccacttcgagaagatccaggggtacatccccgaggcgccccgggacggccaggcctacgtgcgcaaggacggggagtgggtgctcctgagcaccttcctgcggtccgacaagacccacacgtgcccgccctgccccgcccccgagctcctgggcgggccgagcgtcttcctgttcccgcccaagcccaaggacaccctcatgatctcccgcacccccgaggtgacctgcgtggtcgtggacgtgagccacgaggaccccgaggtcaagttcaactggtacgtggacggcgtggaggtccacaacgccaagacgaagccccgggaggagcagtacaactccacctaccgcgtggtgagcgtcctgaccgtgctgcaccaggactggctcaacggcaaggagtacaagtgcaaggtgtccaacaaggccctgcccgcgccgatcgagaagaccatcagcaaggccaaggggcagccccgggagccccaggtctacacgctgcccccgtcccgcgaggagatgaccaagaaccaggtgagcctgacctgcctggtgaagggcttctacccctccgacatcgccgtcgagtgggagagcaacgggcagcccgagaacaactacaagaccacgcccccggtgctggactccgacggcagcttcttcctctactccaagctgaccgtggacaagagccggtggcagcaggggaacgtcttctcctgcagcgtgatgcacgaggccctgcacaaccactacacccagaagtccctcagcctgagccccggcaag

SEQ ID NO: 12848 - RNA, 900 nt, synthetic construct; identical to SEQ ID NO: 12847
  misc_feature 1..900: note = derived and/or modified sequence opt1 from anti-influenza_Chain
  source 1..900: mol_type = other RNA

SEQ ID NO: 12849 - RNA, 927 nt, synthetic construct
  misc_feature 1..927: note = derived and/or modified sequence opt1 from anti-influenza_Chain
  source 1..927: mol_type = other RNA
atggtgaaccgccgggacctgatcaagtggagcgccgtcgccctcggcgcgggggccggcctggccgggcccgccccggccgcgcacgccgccgacctggagtgggagcagtaccccgtgcccgccgcgcccggcgggaaccgctcctggcagctcctgccgagccactccgacgacttcaactacaccggcaagccccagaccttccggggccgctggctggaccagcacaaggacgggtggagcggccccgccaactccctctacagcgcccggcactcctgggtggccgacgggaacctgatcgtcgagggccgccgggcccccgacgggcgcgtgtactgcggctacgtgacgagccggaccccggtcgagtaccccctgtacaccgaggtgctcatgcgcgtgtccggcctgaagctgagctccaacttctggctcctgagccgggacgacgtcaacgagatcgacgtgatcgagtgctacgggaacgagtccctgcacggcaagcacatgaacaccgcgtaccacatcttccagcgcaaccccttcacggagctcgcccggagccagaaggggtacttcgccgacggctcctacggctacaacggggagaccggccaggtgttcggggacggcgccgggcagcccctgctgcgcaacggcttccaccggtacggcgtccactggatcagcgccaccgagttcgacttctacttcaacgggcgcctcgtgcggcgcctgaaccggtccaacgacctgcgcgacccgcggagccgcttcttcgaccagcccatgcacctcatcctgaacaccgagtcccaccagtggcgcgtggaccggggcatcgagcccacggacgcggagctggccgaccccagcatcaacaacatctactaccgctgggtccggacctaccaggccgtg

SEQ ID NO: 12850 - RNA, 927 nt, synthetic construct; identical to SEQ ID NO: 12849
  misc_feature 1..927: note = derived and/or modified sequence opt1 from anti-influenza_Chain
  source 1..927: mol_type = other RNA

SEQ ID NO: 12851 - RNA, 960 nt, synthetic construct
  misc_feature 1..960: note = derived and/or modified sequence opt1 from anti-influenza_Chain
  source 1..960: mol_type = other RNA
atctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctgtcccggatcaaccacttcgagaagatccagatcatccccaagagctcctggagcgaccacgaggcctccagcggcgtctccagcgcctgcccgtaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagaacggccgcatggacttcttctggaccatcctgaagcccaacgacgccatcaacttcgagtccaacgggaacttcatcgcgcccgagtacgcctacaagatcgtcaagaagggcgacagcgccatcgtgaagtccgaggtggagtacggcaactgcaacaccaagtgccagaccccgatcggggccatcaacagcagcatgcccttccacaacatccaccccctcacgatcggcgagtgccccaagtacgtcaagtccaacaagctggtgctggccaccgggctccggaacagcccgctg

SEQ ID NO: 12852 - RNA, 960 nt, synthetic construct; identical to SEQ ID NO: 12851
  misc_feature 1..960: note = derived and/or modified sequence opt1 from anti-influenza_Chain
  source 1..960: mol_type = other RNA

SEQ ID NO: 12853 - RNA, 960 nt, synthetic construct; identical to SEQ ID NO: 12851
  misc_feature 1..960: note = derived and/or modified sequence opt1 from anti-influenza_Chain
  source 1..960: mol_type = other RNA

SEQ ID NO: 12854 - RNA, 978 nt, synthetic construct
  misc_feature 1..978: note = derived and/or modified sequence opt1 from anti-influenza_Chain
  source 1..978: mol_type = other RNA
accctgtgcatcggctaccacgccaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctacatcgtggagacctccagctccgacaacgggacctgctaccccggcgacttcatcgactacgaggagctccgggagcagctgagctccgtcagctccttcgagcgcttcgagatcttccccaagaccagctcctggcccaaccacgacagcaacaagggcgtgacggccgcctgcccgcacgccggcgcgaagtccttctacaagaacctgatctggctcgtgaagaaggggaacagctaccccaagctgtccaagagctacatcaacgacaagggcaaggaggtcctggtgctctgggggatccaccaccccagcacctccgccgaccagcagagcctgtaccagaacgccgacgcctacgtgttcgtcggcacctcccggtacagcaagaagttcaagcccgagatcgcgatccgcccgaaggtgcgggaccaggagggccgcatgaactactactggaccctggtggagcccggggacaagatcacgttcgaggccaccggcaacctcgtcgtgccccggtacgccttcgccatggagcgcgacgccgggtccggcatcatcatcagcgacacccccgtgcacgactgcaacaccacgtgccagaccccgaagggcgcgatcaacacctccctgcccttccagaacatccaccccatcaccatcgggaagtgccccaagtacgtcaagagcacgaagctgcggctcgccaccggcctgcgcaacgtgccgtccatccagagccgg

SEQ ID NO: 12855 - RNA, 978 nt, synthetic construct; identical to SEQ ID NO: 12854
  misc_feature 1..978: note = derived and/or modified sequence opt1 from anti-influenza_Chain
  source 1..978: mol_type = other RNA

SEQ ID NO: 12856 - RNA, 960 nt, synthetic construct; identical to SEQ ID NO: 12851
  misc_feature 1..960: note = derived and/or modified sequence opt1 from anti-influenza_Chain
  source 1..960: mol_type = other RNA

SEQ ID NO: 12857 - RNA, 990 nt, synthetic construct
  misc_feature 1..990: note = derived and/or modified sequence opt1 from anti-influenza_Chain
  source 1..990: mol_type = other RNA
atgtgcagctccatccccagcctgcgcgaggtgttcgccaacgacttccggatcggcgccgcggtcaacccggtgaccctcgaggcccagcagtccctgctgatccgccacgtgaacagcctcaccgccgagaaccacatgaagttcgagcacctccagcccgaggaggggcggttcacgttcgacatcgccatcaagtccagcacctcccccttcagctcccacggcgtccgcgggcacaccctggtgtggcacaaccagacccccagctgggtgttccaggactcccagggccacttcgtcgggcgggacgtgctgctggagcgcatgaagtcccacatcagcacggtggtccagcggtacaagggcaaggtgtactgctgggacgtgatcaacgaggccgtcgcggacgagggcagcgagtggctgcgctccagcacctggcggcagatcatcggggacgacttcatccagcaggccttcctctacgcccacgaggccgacccggaggcgctgctgttctacaacgactacaacgagtgcttccccgagaagcgcgagaagatctacaccctcgtgaagtccctgcgggacaagggcatccccatccacgggatcggcatgcaggcccactggagcctgaaccgccccaccctcgacgagatccgggccgccatcgagcgctacgcctccctgggggtgatcctgcacatcacggagctcgacatcagcatgttcgagttcgacgaccaccggaaggacctggcggccccgaccaacgagatggtcgagcgccaggccgagcggtacgagcagatcttcagcctgttcaaggagtaccgcgacgtgatccagaacgtgaccttctggggcatcgccgacgaccacacctggctcgaccacttccccgtccagggccggaagaactggcccctgctgttcgacgagcagcacaaccccaagccggccttctggcgcgtggtgaacatc

SEQ ID NO: 12858 - RNA, 990 nt, synthetic construct; identical to SEQ ID NO: 12857
  misc_feature 1..990: note = derived and/or modified sequence opt1 from anti-influenza_Chain
  source 1..990: mol_type = other RNA

SEQ ID NO: 12859 - RNA, 1002 nt, synthetic construct
  misc_feature 1..1002: note = derived and/or modified sequence opt1 from anti-influenza_Chain
  source 1..1002: mol_type = other RNA
atgaagaaccgcgtgatcagcctgctcatggcctccctgctgctcgtcctgagcgtgatcgtggcccccttctacaaggcggaggccgccaccgtcgtgaacaccccgttcgtggccgtcttctccaacttcgacagctcccagtgggagaaggccgactgggcgaacggcagcgtgttcaactgcgtgtggaagccctcccaggtcacgttcagcaacgggaagatgatcctgaccctcgaccgggagtacggcgggtcctacccctacaagagcggcgagtaccgcaccaagtccttcttcgggtacggctactacgaggtgcggatgaaggccgccaagaacgtgggcatcgtcagctccttcttcacctacacggggcccagcgacaacaacccgtgggacgagatcgacatcgagttcctgggcaaggacaccaccaaggtgcagttcaactggtacaagaacggggtgggcgggaacgagtacctgcacaacctcggcttcgacgcctcccaggacttccacacctacggcttcgagtggcgccccgactacatcgacttctacgtcgacgggaagaaggtgtaccggggcacgcgcaacatccccgtgacccccgggaagatcatgatgaacctgtggccgggcatcggcgtcgacgagtggctggggcggtacgacggccgcacgcccctccaggcggagtacgagtacgtgaagtactaccccaacggggtgccccaggacaacccgacccccacccccaccatcgcccccagcaccccgaccaaccccaacctgcccctgaagggcgacgtcaacggggacggccacgtgaactccagcgactactccctcttcaagcggtacctgctgcgcgtgatcgaccggttccccgtcggcgaccagagcgtggccgacgtcaaccgcgacgggcggatcgacagcacggacctcaccatgctgaagcgctacctgatccgggccatcccgtccctc

SEQ ID NO: 12860 - RNA, 1002 nt, synthetic construct; identical to SEQ ID NO: 12859
  misc_feature 1..1002: note = derived and/or modified sequence opt1 from anti-influenza_Chain
  source 1..1002: mol_type = other RNA

SEQ ID NO: 12861 - RNA, 1041 nt, synthetic construct
  misc_feature 1..1041: note = derived and/or modified sequence opt1 from anti-influenza_Chain
  source 1..1041: mol_type = other RNA
atctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctgtcccggatcaaccacttcgagaagatccagatcatccccaagagctcctggagcgaccacgaggcctccagcggcgtctccagcgcctgcccgtaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagaacggccgcatggacttcttctggaccatcctgaagcccaacgacgccatcaacttcgagtccaacgggaacttcatcgcgcccgagtacgcctacaagatcgtcaagaagggcgacagcgccatcgtgaagtccgaggtggagtacggcaactgcaacaccaagtgccagaccccgatcggggccatcaacagcagcatgcccttccacaacatccaccccctcacgatcggcgagtgccccaagtacgtcaagtccaacaagctggtgctggccaccgggctccggaacagcccgctgggctacatccccgaggcgccccgcgacggccaggcctacgtgcggaaggacggggagtgggtcctgctctccaccttcctg

SEQ ID NO: 12862 - RNA, 1041 nt, synthetic construct; identical to SEQ ID NO: 12861
  misc_feature 1..1041: note = derived and/or modified sequence opt1 from anti-influenza_Chain
  source 1..1041: mol_type = other RNA

SEQ ID NO: 12863 - RNA, 1047 nt, synthetic construct
  misc_feature 1..1047: note = derived and/or modified sequence opt1 from anti-influenza_Chain
  source 1..1047: mol_type = other RNA
atgaacatcaagaagaccgccgtcaagagcgccctggcggtggccgccgccgccgcggccctcaccacgaacgtgtccgccaaggacttcagcggcgccgagctgtacaccctggaggaggtgcagtacgggaagttcgaggcgcgcatgaagatggccgccgcctccggcaccgtcagctccatgttcctctaccagaacgggagcgagatcgccgacggccggccctgggtggaggtggacatcgaggtcctggggaagaacccgggctccttccagagcaacatcatcaccggcaaggcgggggcccagaagacgtccgagaagcaccacgccgtgagccccgccgccgaccaggcgttccacacctacggcctggagtggacccccaactacgtgcgctggaccgtcgacgggcaggaggtgcggaagacggagggcggccaggtgtccaacctcaccgggacccagggcctgcgcttcaacctgtggagctccgagagcgccgcctgggtcgggcagttcgacgagtccaagctccccctgttccagttcatcaactgggtgaaggtgtacaagtacaccccgggccagggggagggcggcagcgacttcacgctggactggaccgacaacttcgacaccttcgacgggtcccggtggggcaagggggactggaccttcgacggcaaccgcgtcgacctcacggacaagaacatctacagccgggacgggatgctgatcctggccctcacccgcaagggccaggagtccttcaacggccaggtgccccgggacgacgagcccgcgccccagagcagctccagcgccccggcctccagctccagcgtgcccgcctccagctccagcgtccccgcctccagctccagcgccttcgtgcccccgtccagctccagcgcgaccaacgccatccacgggatgcgcaccacgcccgccgtggccaaggagcaccggaacctggtcaacgcgaagggcgccaaggtgaaccccaacgggcacaagcgctaccgggtgaacttcgagcac

SEQ ID NO: 12864 - RNA, 1047 nt, synthetic construct
  misc_feature 1..1047: note = derived and/or modified sequence opt1 from anti-influenza_Chain
  source 1..1047: mol_type = other RNA
gaggtgcagctggtcgagagcggcgggggcgtggtgcagcccgggcgctccctccggctgagctgcgccgcctccggcttcgcgttccacaaccgcgccatgcactgggtccggcaggccccggggaagggcctggagtgggtggccctcatctacttcgacggcagcaagcagtactacgccgactccgtgaaggggcgcttcaccatcagccgggacaactccaagaacaccgtcttcctgcagatgaacagcctgcgccccgaggacacggcggtgtactactgcgccgtgcccggccccatcttcgggatcttcccgccctggtcctacttcgaccactggggccaggggatcctcgtcaccgtgagctccgccagcaccaagggcccctccgtgttccccctggccccgagctccaagagcacctccggcgggacggcggccctgggctgcctcgtcaaggactacttccccgagcccgtgaccgtgagctggaactccggggccctgaccagcggcgtccacaccttccccgccgtgctgcagagctccggcctctacagcctgtccagcgtggtcacggtgccgtccagctccctggggacccagacctacatctgcaacgtgaaccacaagcccagcaacaccaaggtcgacaagaaggtggagcccaagtcctgcgacaagacgcacacgtgcccgccctgccccgcccccgagctcctgggcgggcccagcgtgttcctgttcccgcccaagcccaaggacaccctcatgatctcccggacccccgaggtgacctgcgtcgtcgtggacgtgagccacgaggacccggaggtcaagttcaactggtacgtggacggcgtggaggtccacaacgcgaagaccaagccccgcgaggagcagtacaactccacctaccgggtggtgagcgtcctgaccgtgctgcaccaggactggctcaacgggaaggagtacaagtgcaaggtgtccaacaaggccctgcccgcccccatcgagaagacgatcagcaaggccaagggc

SEQ ID NO: 12865 - RNA, 1047 nt, synthetic construct; identical to SEQ ID NO: 12864
  misc_feature 1..1047: note = derived and/or modified sequence opt1 from anti-influenza_Chain
  source 1..1047: mol_type = other RNA

SEQ ID NO: 12866 - RNA, 1047 nt, synthetic construct; identical to SEQ ID NO: 12863
  misc_feature 1..1047: note = derived and/or modified sequence opt1 from anti-influenza_Chain
  source 1..1047: mol_type = other RNA

SEQ ID NO: 12867 - RNA, 1161 nt, synthetic construct
  misc_feature 1..1161: note = derived and/or modified sequence opt1 from anti-influenza_Chain
  source 1..1161: mol_type = other RNA
atgaacaagttcctgaacaagaagtggagcctcatcctgaccatgggcgggatcttcctgatggccaccctctccctgatcttcgccacgggcaagaaggcgttcaacgaccagaccagcgccgaggacatcccctccctggccgaggccttccgcgactacttcccgatcggggccgcgatcgagcccggctacaccaccgggcagatcgccgagctctacaagaagcacgtgaacatgctggtcgccgagaacgccatgaagcccgcgagcctgcagcccacggagggcaacttccagtgggccgacgccgaccggatcgtgcagttcgccaaggagaacggcatggagctccgcttccacaccctggtgtggcacaaccagaccccgaccgggttctccctggacaaggagggcaagcccatggtcgaggagacggacccccagaagcgggaggagaaccgcaagctcctgctgcagcggctcgagaactacatccgcgccgtggtgctgcggtacaaggacgacatcaagagctgggacgtcgtgaacgaggtgatcgagcccaacgaccccgggggcatgcgcaactccccgtggtaccagatcaccgggaccgagtacatcgaggtcgcgttccgggccacccgcgaggccggcggcagcgacatcaagctgtacatcaacgactacaacacggacgaccccgtgaagcgggacatcctctacgagctggtgaagaacctgctcgagaagggggtccccatcgacggcgtggggcaccagacccacatcgacatctacaacccgcccgtggagcgcatcatcgagtccatcaagaagttcgccggcctgggcctggacaacatcatcaccgagctcgacatgagcatctactcctggaacgaccggagcgactacggggactccatccccgactacatcctgaccctgcaggccaagcgctaccaggagctgttcgacgcgctcaaggagaacaaggacatcgtcagcgccgtggtgttctggggcatctccgacaagtacagctggctgaacgggttccccgtcaagcggacgaacgccccgctcctgttcgaccgcaacttcatgcccaagcccgccttctgggccatcgtggacccctcccggctgcgcgag

SEQ ID NO: 12868 - RNA, 1161 nt, synthetic construct; identical to SEQ ID NO: 12867
  misc_feature 1..1161: note = derived and/or modified sequence opt1 from anti-influenza_Chain
  source 1..1161: mol_type = other RNA

SEQ ID NO: 12869 - RNA, 1221 nt, synthetic construct
  misc_feature 1..1221: note = derived and/or modified sequence opt1 from anti-influenza_Chain
  source 1..1221: mol_type = other RNA
atgcgcaacgtggtccggaagcccctgaccatcggcctcgccctgaccctgctcctgccgatggggatgacggccaccagcgcgaagaacgccgactcctacgccaagaagccccacatcagcgccctgaacgcgccccagctcgaccagcgctacaagaacgagttcaccatcggcgccgccgtggagccctaccagctgcagaacgagaaggacgtgcagatgctgaagcggcacttcaactccatcgtcgccgagaacgtgatgaagccgatcagcatccagcccgaggaggggaagttcaacttcgagcaggccgaccgcatcgtgaagttcgcgaaggccaacggcatggacatccggttccacaccctcgtctggcactcccaggtgccccagtggttcttcctggacaaggaggggaagcccatggtgaacgagacggacccggtcaagcgcgagcagaacaagcagctgctcctgaagcggctggagacccacatcaagaccatcgtggagcgctacaaggacgacatcaagtactgggacgtggtcaacgaggtggtgggcgacgacggcaagctccggaacagcccctggtaccagatcgccgggatcgactacatcaaggtcgccttccaggccgcgcgcaagtacggcggggacaacatcaagctgtacatgaacgactacaacaccgaggtggagcccaagcggacggccctgtacaacctcgtgaagcagctgaaggaggagggcgtccccatcgacgggatcggccaccagtcccacatccagatcggctggccgagcgaggccgagatcgagaagaccatcaacatgttcgccgccctggggctcgacaaccagatcaccgagctggacgtgtccatgtacggctggccgccccgcgcgtaccccacctacgacgccatccccaagcagaagttcctggaccaggccgcccggtacgaccgcctcttcaagctgtacgagaagctgagcgacaagatctccaacgtgacgttctgggggatcgccgacaaccacacctggctcgacagccgggcggacgtctactacgacgccaacggcaacgtggtggtcgaccccaacgccccctacgccaaggtggagaagggcaaggggaaggacgcccccttcgtcttcggcccggactacaaggtgaagcccgcgtactgggccatcatcgaccacaag

SEQ ID NO: 12870 - RNA, 1221 nt, synthetic construct; identical to SEQ ID NO: 12869
  misc_feature 1..1221: note = derived and/or modified sequence opt1 from anti-influenza_Chain
  source 1..1221: mol_type = other RNA

SEQ ID NO: 12871 - RNA, 1233 nt, synthetic construct
  misc_feature 1..1233: note = derived and/or modified sequence opt1 from anti-influenza_Chain
  source 1..1233: mol_type = other RNA
ctgagccgcatcaaccacttcgagaagatccagatcatccccaagtccagctggtccgaccacgaggccagctccggcgtgagctccgcctgcccgtaccaggggacccccagcttcttccggaacgtcgtgtggctcatcaagaagaacaacacctaccccacgatcaagcgctcctacaacaacaccaaccaggaggacctgctgatcctctggggcatccaccacagcaacgacgcggccgagcagaccaagctgtaccagaaccccaccacgtacatctccgtggggaccagcaccctgaaccagcggctcgtcccgaagatcgccacccgctccaaggtgaacggccagaacgggcggatggacttcttctggacgatcctgaagcccaacgacgccatcaacttcgagagcaacggcaacttcatcgcccccgagtacgcgtacaagatcgtgaagaagggctacatccccgaggccccgcgcgacgggcaggcctacgtccggaaggacggcgagtgggtgctgctctccaccttcctgcgcagcgacaagacccacacgtgcccgccctgccccgcccccgagctgctcgggggcccctccgtgttcctgttcccgcccaagcccaaggacaccctgatgatcagccggacccccgaggtgacctgcgtcgtggtcgacgtgtcccacgaggaccccgaggtgaagttcaactggtacgtcgacggggtggaggtgcacaacgcgaagaccaagccccgcgaggagcagtacaacagcacgtaccgggtcgtgagcgtgctcaccgtcctgcaccaggactggctgaacggcaaggagtacaagtgcaaggtgtccaacaaggccctcccggcccccatcgagaagaccatcagcaaggccaagggccagccccgcgagccccaggtgtacaccctgccgccctcccgggaggagatgacgaagaaccaggtcagcctgacctgcctcgtgaaggggttctacccctccgacatcgccgtcgagtgggagagcaacggccagcccgagaacaactacaagaccaccccgcccgtgctggactccgacgggagcttcttcctgtactccaagctcacggtggacaagagccgctggcagcagggcaacgtcttctcctgcagcgtgatgcacgaggcgctgcacaaccactacacccagaagtccctgagcctctcccccggcaag

SEQ ID NO: 12872 - RNA, 1233 nt, synthetic construct; identical to SEQ ID NO: 12871
  misc_feature 1..1233: note = derived and/or modified sequence opt1 from anti-influenza_Chain
  source 1..1233: mol_type = other RNA

SEQ ID NO: 12873 - RNA, 1293 nt, synthetic construct
  misc_feature 1..1293: note = derived and/or modified sequence opt1 from anti-influenza_Chain
  source 1..1293: mol_type = other RNA
atggacgaccacgccgagaagttcctgtggggcgtggccaccagcgcgtaccagatcgagggggccacccaggaggacggccgcgggccctccatctgggacgccttcgcccggcgcccgggcgccatccgggacgggagcacgggcgagcccgcgtgcgaccactaccgccggtacgaggaggacatcgccctcatgcagtccctgggcgtccgcgcctaccggttcagcgtggcctggccccgcatcctgcccgaggggcggggccgcatcaacccgaaggggctcgcgttctacgaccggctggtggaccgcctgctcgcctccggcatcacccccttcctgaccctgtaccactgggacctccccctggccctggaggagcgcgggggctggcggagccgggagaccgccttcgccttcgcggagtacgccgaggccgtcgcccgcgccctcgcggaccgggtgcccttcttcgccacgctgaacgagccgtggtgctccgccttcctgggccactggaccggggagcacgcccccggcctccgcaacctggaggccgcgctgcgggccgcccaccacctcctgctggggcacggcctcgccgtggaggccctgcgcgcggccggcgcccggcgcgtcgggatcgtgctgaacttcgcccccgcgtacggcgaggaccccgaggccgtggacgtcgccgaccgctaccacaaccggtacttcctcgacccgatcctggggaagggctaccccgagagccccttccgcgacccgccgcccgtgcccatcctgtcccgggacctcgagctggtggcccgccccctggacttcctcggggtcaactactacgcccccgtgcgggtggcgcccggcaccggcaccctgcccgtccgctacctgcccccggaggggcccgccacggccatgggctgggaggtgtaccccgaggggctccaccacctcctgaagcggctgggccgcgaggtgccctggccgctgtacgtcaccgagaacggggccgcctaccccgacctgtggaccggcgaggcggtggtggaggaccccgagcgggtcgcctacctcgaggcccacgtggaggccgccctgcgcgcgcgggaggagggcgtggacctgcgcgggtacttcgtctggagcctcatggacaacttcgagtgggccttcggctacacccggcgcttcgggctgtactacgtggacttcccgtcccagcggcgcatccccaagcggagcgccctgtggtaccgcgagcggatcgcccgcgcgcagacg

SEQ ID NO: 12874 - RNA, 1293 nt, synthetic construct
  misc_feature 1..1293: note = derived and/or modified sequence opt1 from anti-influenza_Chain
  source 1..1293: mol_type = other RNA
atgaccgagaacgccgagaagttcctgtggggcgtggccaccagcgcgtaccagatcgagggggccacgcaggaggacggccgcgggccctccatctgggacgccttcgcccagcggccgggcgccatccgcgacgggagcaccggcgagcccgcgtgcgaccactaccggcgctacgaggaggacatcgccctcatgcagtccctgggcgtccgggcctaccgcttcagcgtggcctggccccggatcctgcccgaggggcgcggccggatcaacccgaaggggctcgcgttctacgaccgcctggtggaccggctgctcgcctccggcatcacccccttcctgaccctgtaccactgggacctccccctggccctggaggagcgcgggggctggcggagccgcgagacggccttcgccttcgcggagtacgccgaggccgtcgcccgggccctcgcggaccgcgtgcccttcttcgccaccctgaacgagccgtggtgctccgccttcctgggccactggaccggggagcacgcccccggcctccggaacctggaggccgcgctgcgcgccgcccaccacctcctgctggggcacggcctcgccgtggaggccctgcgggcggccggcgcccgccgggtcgggatcgtgctgaacttcgcccccgcgtacggcgaggaccccgaggccgtggacgtcgccgaccgctaccacaaccgcttcttcctcgacccgatcctggggaagggctaccccgagagccccttccgggacccgccgcccgtgcccatcctgtcccgcgacctcgagctggtggcccggcccctggacttcctcggggtcaactactacgcccccgtgcgcgtggcgcccggcaccggcacgctgcccgtccggtacctgcccccggaggggcccgccaccgccatgggctgggaggtgtaccccgaggggctctaccacctcctgaagcgcctgggccgggaggtgccctggccgctgtacgtcaccgagaacggggccgcctaccccgacctgtggaccggcgaggcggtggtggaggaccccgagcgcgtcgcctacctcgaggcccacgtggaggccgccctgcgggcgcgcgaggagggcgtggacctgcgggggtacttcgtctggagcctcatggacaacttcgagtgggccttcggctacacgcgccggttcgggctgtactacgtggacttcccgtcccagcgccggatccccaagcgcagcgccctgtggtaccgggagcgcatcgcccgggcgcagacc

SEQ ID NO: 12875 - RNA, 1293 nt, synthetic construct
  misc_feature 1..1293: note = derived and/or modified sequence opt1 from anti-influenza_Chain
  source 1..1293: mol_type = other RNA
atggccgagaacgccgagaagttcctgtggggcgtggcgaccagcgcctaccagatcgagggggccacccaggaggacggccgcgggccctccatctgggacacgttcgcccggcgcccgggcgccatccgggacgggagcaccggcgagcccgcgtgcgaccactaccaccgctacgaggaggacatcgccctcatgcagtccctgggcgtcggggtgtaccggttcagcgtggcctggccccgcatcctgcccgagggccgggggcgcatcaacccgaagggcctcgccttctacgaccggctggtcgaccgcctgctcgcggccgggatcacccccttcctgaccctgtaccactgggacctcccccaggccctggaggaccggggcggctggcgctcccgggagacggccttcgccttcgcggagtacgccgaggccgtggcccgcgccctggcggaccgggtgcccttcttcgccaccctcaacgagccgtggtgcagcgccttcctggggcactggaccggcgagcacgcccccgggctgcgcaacctcgaggccgcgctgcgggccgcccaccacctcctgctgggccacggcctggccgtcgaggccctccgcgcggccggggccaagcgggtgggcatcgtgctgaacttcgcccccgtctacggggaggaccccgaggcggtggacgtggccgaccgctaccacaaccggtacttcctggacccgatcctcggccgcgggtaccccgagtcccccttccaggacccgccgcccacccccaacctgagccgcgacctggagctcgtcgcccggcccctggacttcctgggcgtgaactactacgcccccgtgcgcgtcgcccccggcacggggcccctccccgtgcggtacctgccgcccgagggccccgtgaccgcgatggggtgggaggtctaccccgagggcctgtaccacctcctgaagcgcctggggcgggaggtgccgtggcccctctacatcaccgagaacggcgccgcctaccccgacctgtggaccggcgaggccgtggtcgaggacccggagcgcgtggcctacctggaggcgcacgtggaggccgccctccgggcccgcgaggagggggtcgacctgcggggctacttcgtgtggtccctgatggacaacttcgagtgggccttcgggtacacgcgccggttcggcctctactacgtcgacttccccagccagcgccggatccccaagcgctccgcgctgtggtaccgggagcgcatcgcccgggcccagctg

SEQ ID NO: 12876 - RNA, 1293 nt, synthetic construct; identical to SEQ ID NO: 12873
  misc_feature 1..1293: note = derived and/or modified sequence opt1 from anti-influenza_Chain
  source 1..1293: mol_type = other RNA

SEQ ID NO: 12877 - RNA, 1293 nt, synthetic construct; identical to SEQ ID NO: 12874
  misc_feature 1..1293: note = derived and/or modified sequence opt1 from anti-influenza_Chain
  source 1..1293: mol_type = other RNA

SEQ ID NO: 12878 - RNA, 1293 nt, synthetic construct; identical to SEQ ID NO: 12875
  misc_feature 1..1293: note = derived and/or modified sequence opt1 from anti-influenza_Chain
  source 1..1293: mol_type = other RNA

SEQ ID NO: 12879 - RNA, 1296 nt, synthetic construct
  misc_feature 1..1296: note = derived and/or modified sequence opt1 from anti-influenza_Chain
  source 1..1296: mol_type = other RNA
atgttcaagcccaactaccacttcttcccgatcaccggctggatgaacgaccccaacgggctgatcttctggaagggcaagtaccacatgttctaccagtacaacccccgcaagcccgagtgggggaacatctgctggggccacgccgtgagcgacgacctcgtccactggcggcacctcccggtggccctgtaccccgacgacgagacccacggggtgttctccggcagcgcggtcgagaaggacggcaagatgttcctggtgtacacgtactaccgcgaccccacccacaacaagggggagaaggagacccagtgcgtggccatgtccgagaacggcctggacttcgtcaagtacgacgggaaccccgtgatcagcaagccgcccgaggagggcacccacgccttccgggaccccaaggtgaaccgctccaacggggagtggcggatggtcctgggcagcggcaaggacgagaagatcgggcgcgtgctcctgtacacgtccgacgacctgttccactggaagtacgagggcgtgatcttcgaggacgagaccaccaaggagatcgagtgccccgacctcgtccggatcggggagaaggacatcctgatctacagcatcacctccacgaacagcgtgctgttctccatgggcgagctcaaggagggcaagctgaacgtggagaagcgcgggctgctcgaccacggcaccgacttctacgccgcccagaccttcttcgggaccgaccgggtcgtggtgatcggctggctgcagagctggctgcgcacggggctctacccgaccaagcgggagggctggaacggcgtcatgtccctgccccgcgagctgtacgtggagaacaacgagctcaaggtgaagcccgtcgacgagctgctggcgctccggaagcgcaaggtgttcgagaccgccaagagcgggaccttcctgctggacgtgaaggagaactcctacgagatcgtctgcgagttcagcggcgagatcgagctccggatggggaacgagtccgaggaggtggtcatcaccaagagccgcgacgagctgatcgtggacacgacccggtccggcgtgagcgggggcgaggtccgcaagagcaccgtggaggacgaggccacgaaccggatccgcgccttcctggactcctgcagcgtggagttcttcttcaacgactccatcgcgttcagcttccggatccaccccgagaacgtctacaacatcctctccgtcaagagcaaccaggtgaagctggaggtgttcgagctggagaacatctggctc

SEQ ID NO: 12880 - RNA, 1296 nt, synthetic construct; identical to SEQ ID NO: 12879
  misc_feature 1..1296: note = derived and/or modified sequence opt1 from anti-influenza_Chain
  source 1..1296: mol_type = other RNA

SEQ ID NO: 12881 - RNA, 1323 nt, synthetic construct
  misc_feature 1..1323: note = derived and/or modified sequence opt1 from anti-influenza_Chain
  source 1..1323: mol_type = other RNA
gaggtgaagctggtcgagagcggcgggggcctcgtgcagcccgggggctccctgcgcctgagctgcgccacctccgggttcaccttcagcgactactacatgtcctgggtgcggcagagcccgggcaaggccctcgagtggctgggcttcacccgctcccgggtcctggggtacaccaccgactacagcgcgtccgtgaagggccgcttcaccatcagccgggacaactcccagagcatcctctacctgcagatgaactccctgcgcggggaggacagcgccacgtactactgcgcccgggaccgccccatggactactggggccaggggacctccgtgaccgtcagctccgccaagaccacgccgcccagcgtgtaccccctcgcccccggctccgcggcccagaccaacagcatggtgaccctgggctgcctggtcaaggggtacttccccgagcccgtgaccgtgacgtggaacagcggctccctcagctccggggtccacaccttcccggccgtgctgcagagcgacctgtacaccctctccagctccgtgaccgtccccagctccacgtggcccagcgagaccgtgacctgcaacgtggcccaccccgcgtccagcaccaaggtcgacaagaagatcgtgccgcgggactgcggctgcaagccctgcatctgcacggtgcccgaggtctccagcgtgttcatcttcccgcccaagcccaaggacgtgctgaccatcaccctgacccccaaggtcacgtgcgtggtcgtggacatctccaaggacgaccccgaggtgcagttcagctggttcgtcgacgacgtggaggtgcacaccgcccagacccagccgcgcgaggagcagttcaactccaccttccggagcgtctccgagctccccatcatgcaccaggactggctgaacggcaaggagttcaagtgccgcgtgaacagcgccgccttccccgcccccatcgagaagacgatcagcaagaccaaggggcggccgaaggcgccccaggtgtacaccatcccgccgcccaaggagcagatggccaaggacaaggtctccctgacctgcatgatcacggacttcttccccgaggacatcaccgtggagtggcagtggaacggccagcccgccgagaactacaagaacacccagcccatcatggacaccgacgggagctacttcgtgtactccaagctcaacgtccagaagtccaactgggaggccggcaacacgttcacgtgcagcgtgctgcacgaggggctgcacaaccaccacaccgagaagtccctcagccacagccccggcaag

SEQ ID NO: 12882 - RNA, 1323 nt, synthetic construct; identical to SEQ ID NO: 12881
  misc_feature 1..1323: note = derived and/or modified sequence opt1 from anti-influenza_Chain
  source 1..1323: mol_type = other RNA

SEQ ID NO: 12883 - RNA, 1329 nt, synthetic construct
  misc_feature 1..1329: note = derived and/or modified sequence opt1 from anti-influenza_Chain
  source 1..1329: mol_type = other RNA
gaggtgcagctgcagcagagcggccccgagctcgtcaagccgggggcctccgtgaagatgagctgcaaggcctccggctacaccttcaccagctacgtgatgcactgggtcaagcagaagcccgggcagggcctggagtggatcgggtacatcaacccctacaacgacggcacgcgctacaacgagaagttccgggtgaaggccaccctgacctccgacaagagctccagcaccgcctacatggagctctccagcctgacgtccgaggacagcgccgtgtactactgcgcccgccggggcctgatcaccacccccaccctcgactactgggggcagggcacgaccctgaccgtctccagcgccaagaccacgccgccctccgtgtaccccctggcgcccgggagcgccgcccagaccaactccatggtgaccctcggctgcctggtcaaggggtacttcccggagcccgtgaccgtgacgtggaacagcggctccctgagcagcggcgtccacaccttccccgccgtgctccagtccgacctgtacaccctgagctccagcgtgaccgtcccctccagcacgtggccgtccgagaccgtgacctgcaacgtggcgcaccccgccagctccaccaaggtcgacaagaagatcgtgccccgcgactgcgggtgcaagccctgcatctgcacggtgccggaggtcagctccgtgttcatcttcccgcccaagcccaaggacgtgctcaccatcaccctgacccccaaggtcacgtgcgtggtcgtggacatcagcaaggacgaccccgaggtgcagttctcctgggtcgacgacgtggaggtgcacaccgcccagacccagccccgggaggagcagttcaacagcaccttccgctccgtcagcgagctgcccatcatgcaccaggactggctcaacggcaaggagttcaagtgccgggtgaactccgccgccttcccggcgcccatcgagaagacgatcagcaagaccaaggggcgccccaaggcgccccaggtgtacaccatcccgccgcccaaggagcagatggccaaggacaaggtctccctgacctgcatgatcacggacttcttccccgaggacatcaccgtggagtggcagtggaacggccagcccgccgagaactacaagaacacccagcccatcatggacaccgacggcagctacttcgtgtacagcaagctgaacgtccagaagtccaactgggaggccgggaacaccttcacgtgcagcgtgctccacgagggcctgcacaaccaccacaccgagaagtccctgagccactcccccgggaag

SEQ ID NO: 12884 - RNA, 1329 nt, synthetic construct; identical to SEQ ID NO: 12883
  misc_feature 1..1329: note = derived and/or modified sequence opt1 from anti-influenza_Chain
  source 1..1329: mol_type = other RNA

SEQ ID NO: 12885 - RNA, 1332 nt, synthetic construct
  misc_feature 1..1332: note = derived and/or modified sequence opt1 from anti-influenza_Chain
  source 1..1332: mol_type = other RNA
aacgtgcccgagtggagctacatcgtcgagaaggccaacccggccaacgacctgtgctaccccggcaacttcaacgactacgaggagctcaagcacctcctgtcccgcatcaaccacttcgagaagatccagatcatccccaagagctcctggagcgaccacgaggcgtccagcggggtgtccagcgcctgcccctaccagggcaccccgtccttcttccggaacgtggtctggctgatcaagaagaacaacacctaccccacgatcaagcgcagctacaacaacaccaaccaggaggacctgctgatcctctgggggatccaccactccaacgacgccgccgagcagaccaagctgtaccagaaccccaccacgtacatcagcgtgggcacctccaccctgaaccagcggctcgtgcccaagatcgccacccgcagcaaggtcaacgggcagaacggccggatggacttcttctggacgatcctgaagccgaacgacgcgatcaacttcgagtccaacggcaacttcatcgcccccgagtacgcctacaagatcgtgaagaaggggtacatccccgaggcgccccgcgacggccaggcctacgtgcggaaggacggggagtgggtcctgctcagcaccttcctgcgctccgacaagacccacacgtgcccgccctgccccgcccccgagctgctcggcgggccgagcgtgttcctgttcccgcccaagcccaaggacaccctgatgatctcccggacccccgaggtgacctgcgtcgtggtggacgtcagccacgaggaccccgaggtgaagttcaactggtacgtggacggcgtcgaggtgcacaacgccaagaccaagccccgcgaggagcagtacaacagcacgtaccgggtggtctccgtgctcaccgtgctgcaccaggactggctgaacggcaaggagtacaagtgcaaggtcagcaacaaggccctccccgccccgatcgagaagaccatctccaaggcgaaggggcagccccgcgagccccaggtgtacaccctgcccccgagccgggaggagatgacgaagaaccaggtctccctgacctgcctcgtgaagggcttctaccccagcgacatcgccgtggagtgggagtccaacgggcagcccgagaacaactacaagaccaccccgcccgtcctggacagcgacggctccttcttcctgtacagcaagctcacggtggacaagtcccgctggcagcagggcaacgtgttcagctgctccgtcatgcacgaggccctgcacaaccactacacccagaagtccctgagcctcagccccgggaag

SEQ ID NO: 12886 - RNA, 1332 nt, synthetic construct; identical to SEQ ID NO: 12885
  misc_feature 1..1332: note = derived and/or modified sequence opt1 from anti-influenza_Chain
  source 1..1332: mol_type = other RNA

SEQ ID NO: 12887 - RNA, 1341 nt, synthetic construct
  misc_feature 1..1341: note = derived and/or modified sequence opt1 from anti-influenza_Chain
  source 1..1341: mol_type = other RNA
caggtgcagctgcaggagagcggccccgggctcgtcaagccgtccgagaccctgagcctgacctgcaccgtgtccggcgggctcatcggcaccgggagctactactggggctggatccgccagacccccggcaaggggatggagtggatcggctccatcagctactccgggagcacctactaccacccctccctcaagagccgggtgacgatctccgacgacaccagcaagaaccagctgttcctgaagctgcgctccgtcaccgccgccgacaccgcgcagtactactgcgcccggtacaactggggcatccgctacttcgacttctgggggcggggcacgctggtgaccgtgagctccgccagcaccaagggcccctccgtcttcccgctcgccccctgcagccgctccaccagcgagagcacggccgcgctggggtgcctggtgaaggactacttccccgagcccgtgaccgtctcctggaacagcggcgccctcacctccggggtgcacaccttcccggccgtgctgcagagctccggcctgtacagcctctccagcgtcgtgacggtgccctccagctccctgggcaccaagacctacacgtgcaacgtcgaccacaagcccagcaacaccaaggtggacaagacccgggagtccaagtacgggcccccgtgccccagctgccccgcccccgagttcctgggcgggccgtccgtgttcctcttcccgcccaagcccaaggacaccctgatgatcagccgcacccccgaggtcacgtgcgtggtggtcgacgtgtcccaggaggaccccgaggtgcagttcaactggtacgtcgacggcgtggaggtccacaacgcgaagaccaagccccgggaggagcagttcaacagcacctaccgcgtggtgtccgtcctgaccgtgctccaccaggactggctgaacgggaaggagtacaagtgcaaggtgagcaacaagggcctgcccagctccatcgagaagacgatcagcaaggccaagggccagccgcgggagccccaggtctacaccctcccgcccgcccaggaggagatgaccaagaaccaggtgtccctgacctgcctggtgaaggggttctaccccagcgacatcgccgtcgagtgggagtccaacggccagcccgagaacaactacaagacgacgcccccggtgctcgacagcgacgggtccttcttcctgtacagccgcctgaccgtggacaagtcccggtggcaggagggcaacgtcttcagctgctccgtgatgcacgaggccctccacaaccactacacccagaagtccctgagcctgagcctcgggaag

SEQ ID NO: 12888 - RNA, 1341 nt, synthetic construct; identical to SEQ ID NO: 12887
  misc_feature 1..1341: note = derived and/or modified sequence opt1 from anti-influenza_Chain
  source 1..1341: mol_type = other RNA

SEQ ID NO: 12889 - RNA, 1344 nt, synthetic construct
  misc_feature 1..1344: note = derived and/or modified sequence opt1 from anti-influenza_Chain
  source 1..1344: mol_type = other RNA
gaggtgcagctgcaggagagcggccccgggctcgtcaagccctcccagaccctgagcctgacctgcaacgtgtccggcgggagcatcacgggcgactacaagtggtcctggatccgccagccgcccgggaagggcctcgagtggatcggccacatccacagcaccgggaccacctactacaacccctccctgcggagccgcatcacgatctccatggacaccagcaagaacaacctgtccctccggctgaccagcgtgaccgccgccgacacggcggtctactactgcgcctcccacaccctgaccagcggccactacccccgcgacttcgacttctgggggcagggcaccctcgtgacggtgtccagcgcctccaccaaggggcccagcgtcttccccctggccccctgctcccggagcaccagcgagtccaccgccgcgctgggctgcctcgtgaaggactacttcccggagcccgtgacggtcagctggaactccggcgccctgaccagcggggtgcacaccttccccgccgtgctgcagtccagcggcctctactccctgagctccgtcgtgaccgtgacgagctccaacttcgggacccagacctacacgtgcaacgtcgaccacaagcccagcaacaccaaggtggacaagaccgtggagcgcaagtgctgcgtcgagtgcccgccctgccccgcgcccccggtggccggcccctccgtgttcctgttcccgcccaagcccaaggacaccctcatgatcagccggacccccgaggtcacgtgcgtggtggtcgacgtgtcccacgaggaccccgaggtccagttcaactggtacgtggacggcatggaggtgcacaacgccaagaccaagccccgcgaggagcagttcaacagcaccttccgggtcgtgtccgtgctgaccgtcgtgcaccaggactggctgaacgggaaggagtacaagtgcaaggtgagcaacaagggcctcccggcccccatcgagaagacgatctccaagaccaaggggcagccccgcgagccccaggtctacaccctgccgcccagccgggaggagatgaccaagaaccaggtgagcctgacgtgcctcgtgaagggcttctacccctccgacatcgccgtcgagtgggagagcaacgggcagccggagaacaactacaagaccaccccgcccatgctggactccgacggcagcttcttcctgtactccaagctcaccgtggacaagagccgctggcagcagggcaacgtgttctcctgcagcgtcatgcacgaggccctgcacaaccactacacccagaagtccctgagcctctccgggaag

SEQ ID NO: 12890 - RNA, 1350 nt, synthetic construct
  misc_feature 1..1350: note = derived and/or modified sequence opt1 from anti-influenza_Chain
  source 1..1350: mol_type = other RNA
caggtgcagctgcagcagagcggcgccgaggtcaagaagcccgggtccagcgtgaaggtgtcctgcaaggtcagcggcgtgatcttctccgggagcgccatctcctgggtgcgccaggcgccgggccaggggctcgagtggatgggcggcatcagccccctgttcgggaccaccaactacgcccagaagttccagggccgggtcacgatcaccgccgaccagtccaccaacaccacgtacatggaggtgaacagcctgcgctacgaggacaccgccgtgtacttctgcgcccgggggcccaagtactactccgagtacatggacgtctggggcaaggggaccaccgtgacggtgagctccgcgagcaccaagggcccctccgtcttcccgctcgcccccagctccaagagcacctccggcgggaccgccgccctgggctgcctggtgaaggactacttccccgagcccgtgacggtcagctggaacagcggggcgctcacctccggcgtgcacaccttcccggccgtgctgcagagctccggcctgtacagcctctccagcgtcgtgaccgtgccctccagctccctggggacgcagacctacatctgcaacgtcaaccacaagcccagcaacaccaaggtggacaagcgcgtggagcccaagtcctgcgacaagacccacacgtgcccgccctgccccgcccccgagctgctcggcgggccgagcgtcttcctgttcccgcccaagcccaaggacaccctgatgatctcccggacccccgaggtgacctgcgtcgtggtggacgtcagccacgaggaccccgaggtgaagttcaactggtacgtggacggcgtcgaggtgcacaacgccaagacgaagccccgcgaggagcagtacaactccacctaccgggtggtcagcgtgctcaccgtgctgcaccaggactggctgaacgggaaggagtacaagtgcaaggtctccaacaaggccctccccgcgccgatcgagaagaccatcagcaaggccaagggccagccccgcgagccccaggtgtacacgctgcccccgtcccgggaggagatgaccaagaaccaggtgagcctgacctgcctcgtcaagggcttctaccccagcgacatcgccgtggagtgggagtccaacgggcagcccgagaacaactacaagaccacgccgcccgtgctggacagcgacggctccttcttcctgtacagcaagctcaccgtcgacaagtcccgctggcagcaggggaacgtgttcagctgctccgtgatgcacgaggccctgcacaaccactacacccagaagtccctgagcctcagccccggcaag

SEQ ID NO: 12891 - RNA, 1350 nt, synthetic construct
  misc_feature 1..1350: note = derived and/or modified sequence opt1 from anti-influenza_Chain
  source 1..1350: mol_type = other RNA
caggtgcagctggtccagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatggggatgttcggcaccacgaactacgcccagaagttccaggggcgggtgaccatcaccgccgacgagttcaccagcgccgcgtacatggagctgcgctccctgcggagcgaggacacggccgtctactactgcgcccgctccagcggctactaccccgagtacttccaggactgggggcagggcaccctcgtgaccgtgtccagcgcctccaccaagggccccagcgtcttccccctggcgccgtccagcaagtccacgagcgggggcaccgccgccctggggtgcctcgtgaaggactacttccccgagcccgtgaccgtcagctggaactccggcgccctgaccagcggcgtgcacacgttccccgccgtgctgcagtccagcgggctctactccctgagctccgtcgtgaccgtgccgagctccagcctgggcacccagacctacatctgcaacgtcaaccacaagccctccaacacgaaggtggacaagcgggtggagcccaagagctgcgacaagacccacacgtgcccgccctgccccgcgcccgagctcctcgggggcccctccgtcttcctgttcccgcccaagcccaaggacaccctgatgatcagccgcacccccgaggtgacctgcgtggtcgtggacgtctcccacgaggacccggaggtgaagttcaactggtacgtggacggggtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcccccatcgagaagaccatctccaaggccaagggccagccgcgggagccccaggtgtacaccctgccgcccagccgcgaggagatgaccaagaaccaggtgagcctcacgtgcctggtcaaggggttctacccctccgacatcgcggtggagtgggagagcaacggccagcccgagaacaactacaagaccacgcccccggtgctggactccgacgggagcttcttcctctactccaagctgaccgtcgacaagagccggtggcagcagggcaacgtgttctcctgcagcgtgatgcacgaggccctgcacaaccactacacccagaagtccctcagcctgtcccccgggaag

SEQ ID NO: 12892 - RNA, 1350 nt, synthetic construct
  misc_feature 1..1350: note = derived and/or modified sequence opt1 from anti-influenza_Chain
  source 1..1350: mol_type = other RNA
gaggtgcagctggtcgagagcggcgccgaggtgaagaagcccgggtccagcgtgaaggtctcctgcaaggccagcggcgggaccttctccagctacggcatctcctgggtgcgccaggcgccggggcagggcctcgagtggatgggcgacatcatcgggatgttcggcagcaccaactacgcccagaacttccaggggcggctgacgatcaccgccgacgagtccaccagcaccgcctacatggagctgtccagcctccgctccgaggacacggccgtgtactactgcgcgcggagctccggctactaccccgcctacctgccccactgggggcagggcaccctggtcaccgtgagctccgccagcaccaagggcccctccgtgttcccgctcgcccccagcagcaagtccacgagcgggggcaccgcggccctggggtgcctggtcaaggactacttccccgagcccgtgaccgtgtcctggaacagcggcgccctcacctccggcgtccacacgttcccggccgtgctgcagagctccgggctgtacagcctctccagcgtggtcaccgtgccctccagctccctgggcacccagacctacatctgcaacgtgaaccacaagcccagcaacacgaaggtcgacaagcgcgtggagcccaagtcctgcgacaagacccacacgtgcccgccctgccccgcccccgagctgctcgggggcccgagcgtgttcctgttcccgcccaagcccaaggacaccctgatgatctcccggacccccgaggtgacctgcgtcgtggtcgacgtgagccacgaggaccccgaggtcaagttcaactggtacgtggacggggtggaggtccacaacgcgaagaccaagccccgcgaggagcagtacaactccacctaccgggtggtgagcgtcctcacggtgctgcaccaggactggctgaacggcaaggagtacaagtgcaaggtgagcaacaaggccctccccgccccgatcgagaagaccatctccaaggccaagggccagccccgcgagccccaggtctacaccctgcccccgagccgggaggagatgaccaagaaccaggtgtccctgacgtgcctcgtgaaggggttctaccccagcgacatcgccgtcgagtgggagtccaacggccagcccgagaacaactacaagaccaccccgcccgtgctggacagcgacgggtccttcttcctgtacagcaagctcaccgtggacaagtcccgctggcagcagggcaacgtcttcagctgctccgtgatgcacgaggcgctgcacaaccactacacgcagaagtccctgagcctcagccccgggaag

SEQ ID NO: 12893 - RNA, 1350 nt, synthetic construct
  misc_feature 1..1350: note = derived and/or modified sequence opt1 from anti-influenza_Chain
  source 1..1350: mol_type = other RNA
gaggtgcagctggtcgagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatcgggatgttcggcaccgccaactacgcccagaagttccaggggcgggtgacgatcaccgccgacgagttcaccagcaccgcgtacatggagctgtccagcctgcgctccgaggacacggccgtctactactgcgcccggggcaactactactacgagagctccctcgactactgggggcagggcaccctggtgaccgtgagctccgccagcaccaagggcccctccgtcttccccctggcgcccagctccaagagcacgagcgggggcaccgccgccctcgggtgcctggtgaaggactacttcccggagcccgtgaccgtctcctggaacagcggcgccctgacctccggcgtgcacacgttccccgccgtgctccagagctccgggctgtacagcctgtccagcgtcgtgaccgtgccctccagctccctcggcacccagacctacatctgcaacgtcaaccacaagccgagcaacacgaaggtggacaagcgcgtggagcccaagtcctgcgacaagacccacacgtgcccgccctgcccggcgcccgagctgctcgggggccccagcgtcttcctgttcccgcccaagcccaaggacaccctgatgatctcccggacccccgaggtgacctgcgtggtcgtggacgtcagccacgaggaccccgaggtgaagttcaactggtacgtggacggggtcgaggtgcacaacgccaagaccaagccgcgcgaggagcagtacaactccacctaccgggtggtcagcgtgctgacggtgctccaccaggactggctgaacggcaaggagtacaagtgcaaggtctccaacaaggccctgcccgcccccatcgagaagaccatcagcaaggccaagggccagccccgcgagccccaggtgtacaccctcccgcccagccgggaggagatgaccaagaaccaggtgtccctgacgtgcctggtcaaggggttctaccccagcgacatcgcggtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggccctccacaaccactacacgcagaagtccctgagcctgagccccgggaag

SEQ ID NO: 12894 - RNA, 1350 nt, synthetic construct
  misc_feature 1..1350: note = derived and/or modified sequence opt1 from anti-influenza_Chain
  source 1..1350: mol_type = other RNA
gaggtgcagctggtccagagcggcgccgaggtgaagaagcccgggtccagcatgaaggtgtcctgcaaggccagcggctccatcttcagcaactacgggatctcctgggtccgccaggcgccgggccaggggctcgagtggatgggcggcatcatccccatcttcggggccgccaactacgcccagaagttccagggccgggtgaccatcaccgccgacgagagcacgtccaccgtgtacatggaggtccgcagcctgcggtccgaggacaccgcggtgtactactgcgcccgccggcagcagctgtacaaggggtactaccaccactggggccaggggaccctcgtgacggtcagctccgccagcaccaagggcccctccgtgttccccctggccccgagctccaagagcacctccggcgggaccgcggccctgggctgcctcgtgaaggactacttccccgagcccgtcacggtgagctggaacagcggggccctgacctccggcgtgcacaccttccccgccgtcctgcagagctccggcctctacagcctgtccagcgtggtgaccgtcccgtccagctccctggggacgcagacctacatctgcaacgtgaaccacaagcccagcaacaccaaggtggacaagaaggtcgagcccaagtcctgcgacaagacccacacgtgcccgccctgccccgcccccgagctcctgggcgggcccagcgtgttcctgttcccgcccaagcccaaggacaccctcatgatctcccgcacccccgaggtgacctgcgtcgtggtcgacgtgagccacgaggacccggaggtgaagttcaactggtacgtcgacggcgtggaggtgcacaacgcgaagacgaagccccgggaggagcagtacaactccacctaccgcgtcgtgagcgtgctgaccgtcctgcaccaggactggctcaacgggaaggagtacaagtgcaaggtgtccaacaaggccctgcccgcccccatcgagaagaccatcagcaaggccaagggccagccgcgggagccccaggtgtacacgctgccgccctcccgcgaggagatgaccaagaaccaggtcagcctgacctgcctcgtgaagggcttctaccccagcgacatcgccgtggagtgggagtccaacgggcagcccgagaacaactacaagaccacgcccccggtcctggacagcgacggctccttcttcctctacagcaagctgaccgtggacaagtcccggtggcagcaggggaacgtgttcagctgctccgtcatgcacgaggcgctgcacaaccactacacccagaagtccctcagcctgagccccggcaag

SEQ ID NO: 12895 - RNA, 1350 nt, synthetic construct
  misc_feature 1..1350: note = derived and/or modified sequence opt1 from anti-influenza_Chain
  source 1..1350: mol_type = other RNA
caggtgcagctggtccagagcggcgccggggtgaagaagcccggctccagcatgaaggtgtcctgcaaggccagcgggtccatcttcagcaactacggcatctcctgggtccgccaggcgccggggcagggcctcgagtggatgggcgggatcatccccatcttcggcgccgccaactacgcccagaagttccaggggcgggtgaccatcaccgccgacgagagcacgtccaccgtgtacatggaggtccgcagcctgcggtccgaggacaccgcggtgtactactgcgcccgccggcagcagctgtacaagggctactaccaccactgggggcagggcaccctcgtgacggtcagctccgccagcaccaagggcccctccgtgttccccctggccccgagctccaagagcacctccgggggcaccgcggccctggggtgcctcgtgaaggactacttccccgagcccgtcacggtgagctggaacagcggcgccctgacctccggcgtgcacaccttccccgccgtcctgcagagctccgggctctacagcctgtccagcgtggtgaccgtcccgtccagctccctgggcacgcagacctacatctgcaacgtgaaccacaagcccagcaacaccaaggtggacaagaaggtcgagcccaagtcctgcgacaagacccacacgtgcccgccctgccccgcccccgagctcctcgggggccccagcgtgttcctgttcccgcccaagcccaaggacaccctcatgatctcccgcacccccgaggtgacctgcgtcgtggtcgacgtgagccacgaggacccggaggtgaagttcaactggtacgtcgacggggtggaggtgcacaacgcgaagacgaagccccgggaggagcagtacaactccacctaccgcgtcgtgagcgtgctgaccgtcctgcaccaggactggctcaacggcaaggagtacaagtgcaaggtgtccaacaaggccctgcccgcccccatcgagaagaccatcagcaaggccaagggccagccgcgggagccccaggtgtacacgctgccgccctcccgcgaggagatgaccaagaaccaggtcagcctgacctgcctggtgaaggggttctaccccagcgacatcgccgtggagtgggagtccaacggccagcccgagaacaactacaagaccacgcccccggtcctggacagcgacgggtccttcttcctctacagcaagctgaccgtggacaagtcccggtggcagcagggcaacgtgttcagctgctccgtcatgcacgaggcgctgcacaaccactacacccagaagtccctcagcctgagccccgggaag

SEQ ID NO: 12896 - RNA, 1350 nt, synthetic construct
  misc_feature 1..1350: note = derived and/or modified sequence opt1 from anti-influenza_Chain
  source 1..1350: mol_type = other RNA
caggtgcagctggtccagagcggcgccgaggtgcgcaagcccgggtccagcgtgaaggtctcctgcaaggtgagcggcgggatcatccggaagtacgccatcaactgggtgcgccaggcgccgggccaggggctcgagtggatgggcggcatcatcgccatcttcaacaccgccaactacgcccagaagttccaggggcgggtcaccatcacggccgacgagtccaccagcaccgtgtacatggagctgtccagcctgcgctccgaggacaccgcgctctactactgcgcccggggcatgaactactacagcgactacttcgactactgggggcagggctccctggtgacggtcagccccgcctccaccaaggggcccagcgtgttccccctggccccgtccagcaagtccaccagcggcggcaccgcggccctcgggtgcctggtgaaggactacttccccgagcccgtcacggtgtcctggaacagcggcgccctgaccagcggggtgcacaccttccccgccgtcctccagtccagcggcctgtactccctgagctccgtggtgaccgtcccgagctccagcctcggcacgcagacctacatctgcaacgtgaaccacaagccctccaacaccaaggtggacaagaaggtcgagcccaagagctgcgacaagacccacacgtgcccgccctgccccgcccccgagctgctcgggggcccctccgtgttcctgttcccgcccaagcccaaggacaccctgatgatcagccgcacccccgaggtgacctgcgtcgtggtcgacgtgtcccacgaggacccggaggtgaagttcaactggtacgtcgacggggtggaggtgcacaacgcgaagacgaagccccgggaggagcagtacaacagcacctaccgcgtcgtgtccgtgctgaccgtcctccaccaggactggctgaacggcaaggagtacaagtgcaaggtgagcaacaaggccctgcccgcccccatcgagaagaccatctccaaggccaaggggcagccgcgggagccccaggtgtacacgctcccgcccagccgcgacgagctgaccaagaaccaggtctccctgacctgcctcgtgaagggcttctaccccagcgacatcgccgtggagtgggagagcaacggccagcccgagaacaactacaagaccacgcccccggtcctggactccgacgggagcttcttcctgtactccaagctcaccgtggacaagagccggtggcagcagggcaacgtgttctcctgcagcgtcatgcacgaggcgctgcacaaccactacacccagaagtccctgagcctctcccccgggaag

SEQ ID NO: 12897 - RNA, 1350 nt, synthetic construct; identical to SEQ ID NO: 12896
  misc_feature 1..1350: note = derived and/or modified sequence opt1 from anti-influenza_Chain
  source 1..1350: mol_type = other RNA

SEQ ID NO: 12898 - RNA, 1350 nt, synthetic construct; identical to SEQ ID NO: 12894
  misc_feature 1..1350: note = derived and/or modified sequence opt1 from anti-influenza_Chain
  source 1..1350: mol_type = other RNA

SEQ ID NO: 12899 - RNA, 1350 nt, synthetic construct; identical to SEQ ID NO: 12895
  misc_feature 1..1350: note = derived and/or modified sequence opt1 from anti-influenza_Chain
  source 1..1350: mol_type = other RNA

SEQ ID NO: 12900 - RNA, 1350 nt, synthetic construct; identical to SEQ ID NO: 12890
  misc_feature 1..1350: note = derived and/or modified sequence opt1 from anti-influenza_Chain
  source 1..1350: mol_type = other RNA

SEQ ID NO: 12901 - RNA, 1350 nt, synthetic construct; identical to SEQ ID NO: 12891
  misc_feature 1..1350: note = derived and/or modified sequence opt1 from anti-influenza_Chain
  source 1..1350: mol_type = other RNA

SEQ ID NO: 12902 - RNA, 1350 nt, synthetic construct; identical to SEQ ID NO: 12892
  misc_feature 1..1350: note = derived and/or modified sequence opt1 from anti-influenza_Chain
  source 1..1350: mol_type = other RNA

SEQ ID NO: 12903 - RNA, 1350 nt, synthetic construct; identical to SEQ ID NO: 12893
  misc_feature 1..1350: note = derived and/or modified sequence opt1 from anti-influenza_Chain
  source 1..1350: mol_type = other RNA

SEQ ID NO: 12904 - RNA, 1353 nt, synthetic construct
  misc_feature 1..1353: note = derived and/or modified sequence opt1 from anti-influenza_Chain
  source 1..1353: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccgccagcacgaagggcccctccgtgttccccctggcccccagctccaagagcacctccgggggcaccgcggccctcgggtgcctggtcaaggactacttcccggagcccgtgaccgtgagctggaactccggcgccctgacgagcggcgtccacaccttccccgccgtgctccagagctccgggctgtacagcctgtccagcgtggtcaccgtgccctccagctccctcggcacccagacgtacatctgcaacgtgaaccacaagccgagcaacaccaaggtcgacaagcgggtggagcccaagtcctgcgacaagacccacacgtgcccgccctgccccgcccccgagctgctcgggggccccagcgtgttcctgttcccgcccaagcccaaggacaccctgatgatctcccgcacccccgaggtgacctgcgtcgtcgtggacgtgagccacgaggaccccgaggtcaagttcaactggtacgtggacggggtggaggtccacaacgcgaagaccaagccgcgggaggagcagtacaactccacgtaccgcgtggtgagcgtcctgaccgtgctccaccaggactggctgaacggcaaggagtacaagtgcaaggtgtccaacaaggccctgcccgcccccatcgagaagaccatcagcaaggccaagggccagccccgggagccgcaggtctacaccctcccgccctcccgcgaggagatgacgaagaaccaggtgagcctgacctgcctggtgaaggggttctacccctccgacatcgccgtcgagtgggagagcaacggccagcccgagaacaactacaagaccaccccgcccgtgctcgacagcgacgggtccttcttcctgtacagcaagctgacggtggacaagtcccggtggcagcagggcaacgtcttcagctgctccgtgatgcacgaggcgctccacaaccactacacccagaagtccctgagcctgagccccgggaag

SEQ ID NO: 12905 - RNA, 1353 nt, synthetic construct
  misc_feature 1..1353: note = derived and/or modified sequence opt1 from anti-influenza_Chain
  source 1..1353: mol_type = other RNA
caggtgcagctggtccagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccgccagcacgaagggcccctccgtgttccccctggcccccagctccaagagcacctccgggggcaccgcggccctcgggtgcctggtcaaggactacttcccggagcccgtgaccgtgagctggaactccggcgccctgacgagcggcgtccacaccttccccgccgtgctccagagctccgggctgtacagcctgtccagcgtggtcaccgtgccctccagctccctcggcacccagacgtacatctgcaacgtgaaccacaagccgagcaacaccaaggtcgacaagcgggtggagcccaagtcctgcgacaagacccacacgtgcccgccctgccccgcccccgagctgctcgggggccccagcgtgttcctgttcccgcccaagcccaaggacaccctgatgatctcccgcacccccgaggtgacctgcgtcgtcgtggacgtgagccacgaggaccccgaggtcaagttcaactggtacgtggacggggtggaggtccacaacgcgaagaccaagccgcgggaggagcagtacaactccacgtaccgcgtggtgagcgtcctgaccgtgctccaccaggactggctgaacggcaaggagtacaagtgcaaggtgtccaacaaggccctgcccgcccccatcgagaagaccatcagcaaggccaagggccagccccgggagccgcaggtctacaccctcccgccctcccgcgaggagatgacgaagaaccaggtgagcctgacctgcctggtgaaggggttctacccctccgacatcgccgtcgagtgggagagcaacggccagcccgagaacaactacaagaccaccccgcccgtgctcgacagcgacgggtccttcttcctgtacagcaagctgacggtggacaagtcccggtggcagcagggcaacgtcttcagctgctccgtgatgcacgaggcgctccacaaccactacacccagaagtccctgagcctgagccccgggaag

SEQ ID NO: 12906 - RNA, 1353 nt, synthetic construct
  misc_feature 1..1353: note = derived and/or modified sequence opt1 from anti-influenza_Chain
  source 1..1353: mol_type = other RNA
gaggtgcagctggtcgagagcggcgccgaggtgaagaagcccgggtccagcgtgaaggtctcctgcaaggccagcggcgggaccttctccttctacagcatgtcctgggtgcgccaggcgccgggccaggggctcgagtggatgggcggcatcatccccatgttcgggaccacgaactacgcccagaagttccagggccgggtgaccatcaccgccgtcgagagcacctccacggcctacatggaggtgagctccctgcgcagcgaggacaccgccgtgtactactgcgcgcgcggggacaagggcatctactactactacatggacgtctgggggaagggcaccaccgtgacggtgtccagcgcctccaccaagggccccagcgtcttccccctggccccgtccagcaagtccaccagcgggggcaccgccgcgctcgggtgcctggtgaaggactacttccccgagcccgtgacggtcagctggaactccggcgccctgaccagcggcgtgcacaccttccccgccgtgctccagtccagcgggctgtactccctgagctccgtcgtgaccgtgccgagctccagcctcggcacgcagacctacatctgcaacgtcaaccacaagccctccaacaccaaggtggacaagcgggtggagcccaagagctgcgacaagacccacacgtgcccgccctgccccgcccccgagctgctcgggggcccctccgtcttcctgttcccgcccaagcccaaggacaccctgatgatcagccggacccccgaggtgacctgcgtcgtggtggacgtctcccacgaggacccggaggtgaagttcaactggtacgtggacggggtcgaggtgcacaacgccaagacgaagccccgcgaggagcagtacaacagcacctaccgggtggtctccgtgctgaccgtgctccaccaggactggctgaacggcaaggagtacaagtgcaaggtcagcaacaaggcgctgcccgcccccatcgagaagaccatctccaaggccaagggccagccgcgcgagccccaggtgtacacgctcccgcccagccgggaggagatgaccaagaaccaggtgagcctgacctgcctggtcaaggggttctacccctccgacatcgccgtggagtgggagagcaacggccagcccgagaacaactacaagaccacgcccccggtgctcgactccgacgggagcttcttcctgtactccaagctgaccgtcgacaagagccgctggcagcagggcaacgtgttctcctgcagcgtgatgcacgaggccctccacaaccactacacccagaagtccctgagcctgtcccccgggaag

SEQ ID NO: 12907 - RNA, 1353 nt, synthetic construct; identical to SEQ ID NO: 12904
  misc_feature 1..1353: note = derived and/or modified sequence opt1 from anti-influenza_Chain
  source 1..1353: mol_type = other RNA

SEQ ID NO: 12908 - RNA, 1353 nt, synthetic construct; identical to SEQ ID NO: 12905
  misc_feature 1..1353: note = derived and/or modified sequence opt1 from anti-influenza_Chain
  source 1..1353: mol_type = other RNA

SEQ ID NO: 12909 - RNA, 1353 nt, synthetic construct; identical to SEQ ID NO: 12906
  misc_feature 1..1353: note = derived and/or modified sequence opt1 from anti-influenza_Chain
  source 1..1353: mol_type = other RNA

SEQ ID NO: 12910 - RNA, 1356 nt, synthetic construct
  misc_feature 1..1356: note = derived and/or modified sequence opt1 from anti-influenza_Chain
  source 1..1356: mol_type = other RNA
caggtgcagctggtccagagcggcgggggcctcgtgaagcccgggggctccctgcgcctgagctgcgccgcctccgggttcaccttcagctcctacagcatgaactgggtgcggcaggcgccgggcaagggcctcgagtgggtctccagcatctccagctccagctcctacatctactacgtggacagcgtgaaggggcgcttcaccatctcccgggacaacgccaagaacagcctgtacctgcagatgaactccctccgcgccgaggacacggccgtctactactgcgcccggggcgggggcagctacggggcgtacgagggcttcgactactggggccaggggaccctggtgaccgtgtccagcgccagcaccaagggcccctccgtcttccccctggcccccagctccaagagcacgtccgggggcaccgccgcgctcggctgcctggtgaaggactacttcccggagcccgtgaccgtcagctggaactccggggccctgaccagcggcgtgcacacgttccccgccgtgctccagtccagcgggctgtactccctgagctccgtcgtgaccgtgcccagctccagcctcggcacccagacctacatctgcaacgtcaaccacaagccgtccaacacgaaggtggacaagcgcgtggagcccaagagctgcgacaagacccacacgtgcccgccctgcccggcccccgagctgctcgggggcccctccgtcttcctgttcccgcccaagcccaaggacaccctgatgatcagccggacccccgaggtgacctgcgtggtcgtggacgtcagccacgaggaccccgaggtgaagttcaactggtacgtggacggcgtcgaggtgcacaacgccaagaccaagccgcgcgaggagcagtacaactccacctaccgggtggtcagcgtgctgacggtgctccaccaggactggctgaacgggaaggagtacaagtgcaaggtctccaacaaggcgctgcccgcccccatcgagaagaccatcagcaaggccaagggccagccccgcgagccccaggtgtacaccctcccgccctcccgggaggagatgaccaagaaccaggtgagcctgacgtgcctggtcaaggggttctacccctccgacatcgccgtggagtgggagagcaacggccagcccgagaacaactacaagaccaccccgcccgtgctcgactccgacgggagcttcttcctgtactccaagctgaccgtcgacaagagccgctggcagcagggcaacgtgttctcctgcagcgtgatgcacgaggccctccacaaccactacacgcagaagtccctgagcctgtcccccggcaag

SEQ ID NO: 12911 - RNA, 1356 nt, synthetic construct
  misc_feature 1..1356: note = derived and/or modified sequence opt1 from anti-influenza_Chain
  source 1..1356: mol_type = other RNA
caggtgcagctggtccagagcggcgccgaggtgaagcagcccggggcctccgtgaaggtcagctgcaaggcgtccggctacaccttcaacgcctactacatccactgggtgcgccaggcccccgggcagggcctcgagtggatggggtggatcaaccccaacttcggcggcacccactacgcccggaagttccaggggcgcgtgacgatgacccgggacgccagcatcaacaccgcgtacatggagctggaccgcctgatctccgacgacaccgccgtctactactgcgtgcggtggcgcgccgccgcggtgatcatggaccagttctacaagatggacgtctggggccaggggacgctcgtgaccgtgagctccgccagcaccaagggcccctccgtcttccccctggccccgtgcagccggtccaccagcgagtccacggccgccctggggtgcctcgtgaaggactacttccccgagcccgtgaccgtcagctggaactccggcgcgctgaccagcggcgtgcacaccttccccgccgtgctgcagtccagcgggctctactccctgagcagcgtcgtgacggtgccgtccagctccctgggcaccaagacctacacgtgcaacgtcgaccacaagcccagcaacaccaaggtggacaagacccgcgagtccaagtacgggccgccctgccccagctgccccgcccccgagttcctcggcggcccctccgtgttcctgttcccgcccaagcccaaggacaccctgatgatcagccggacccccgaggtcacgtgcgtggtcgtggacgtgtcccaggaggacccggaggtccagttcaactggtacgtggacggggtggaggtccacaacgccaagaccaagccccgcgaggagcagttcaacagcacctaccgggtggtgtccgtcctcaccgtgctgcaccaggactggctgaacggcaaggagtacaagtgcaaggtgagcaacaaggggctcccctccagcatcgagaagacgatctccaaggccaagggccagccccgcgagccgcaggtctacaccctgccgcccgcgcaggaggagatgaccaagaaccaggtgagcctgacctgcctcgtgaaggggttctacccctccgacatcgccgtcgagtgggagagcaacggccagcccgagaacaactacaagacgaccccgcccgtgctggactccgacggcagcttcttcctgtacagccggctcaccgtggacaagtcccgctggcaggaggggaacgtcttcagctgctccgtgatgcacgaggccctgcacaaccactacacccagaagtccctgagcctcagcctgggcaag

SEQ ID NO: 12912 - RNA, 1356 nt, synthetic construct
  misc_feature 1..1356: note = derived and/or modified sequence opt1 from anti-influenza_Chain
  source 1..1356: mol_type = other RNA
gaggtgcagctggtccagagcggcgccgaggtgaagaagcccggggcctccgtgaaggtcagctgcaaggcgtccggctacatcttcaccgggtactacatccactgggtgcgccaggccccgggccaggggctcgagtggatgggccggatcgaccccaacggcgccgggaccacgtacgcccagaagttccagggccgcgtgaccctgaccatggacaccagcatcacgaccgcctacatggagctgtcccggctccgcttcgacgacaccgcgatctactactgcgcccggtgggactggaacttcgacctgtacctggggtggttcgacccctggggccaggggacccccgtcacggtggccagcgcctccaccaagggcccgagcgtgttccccctcgcgccctccagcaagtccaccagcggcgggaccgccgccctgggctgcctggtcaaggactacttccccgagccggtgacggtgtcctggaacagcggggccctcacctccggcgtccacaccttccccgccgtgctgcagagctccggcctgtacagcctctccagcgtggtcaccgtgcccagctccagcctggggacgcagacctacatctgcaacgtgaaccacaagccctccaacaccaaggtcgacaagaaggtggagcccaagagctgcgacaagacccacacgtgcccgccctgcgcgcccgagctgctcggcgggccgtccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagacgaagccccgggaggagcagtacaacagcacctaccgcgtggtgtccgtcctcaccgtgctgcaccaggactggctgaacgggaaggagtacaagtgcaaggtgagcaacaaggccctccccgccccgatcgagaagaccatctccaaggccaagggccagccccgggagccccaggtctacacgctgcccccgagccgcgaggagatgaccaagaaccaggtgtccctgacctgcctcgtgaagggcttctaccccagcgacatcgcggtcgagtgggagtccaacgggcagcccgagaacaactacaagaccacgccgcccgtgctggacagcgacggctccttcttcctgtacagcaagctcaccgtggacaagtcccggtggcagcaggggaacgtcttcagctgcagcgtgatgcacgaggccctgcacaaccactacacccagaagtccctgagcctctcccccggcaag

SEQ ID NO: 12913 - RNA, 1356 nt, synthetic construct; identical to SEQ ID NO: 12911
  misc_feature 1..1356: note = derived and/or modified sequence opt1 from anti-influenza_Chain
  source 1..1356: mol_type = other RNA

SEQ ID NO: 12914 - RNA, 1356 nt, synthetic construct; identical to SEQ ID NO: 12910
  misc_feature 1..1356: note = derived and/or modified sequence opt1 from anti-influenza_Chain
  source 1..1356: mol_type = other RNA

SEQ ID NO: 12915 - RNA, 1356 nt, synthetic construct; identical to SEQ ID NO: 12912
  misc_feature 1..1356: note = derived and/or modified sequence opt1 from anti-influenza_Chain
  source 1..1356: mol_type = other RNA

SEQ ID NO: 12916 - RNA, 1359 nt, synthetic construct
  misc_feature 1..1359: note = derived and/or modified sequence opt1 from anti-influenza_Chain
  source 1..1359: mol_type = other RNA
caggtgcagctggtccagagcggcgccgaggtgaagaagcccgggtccagcgtgcgcgtctcctgcaaggccagcggctccatcttccggaactacgcgatgagctgggtgcgccaggccccggggcagggcctcgagtggatgggcgggatcatcgccatcttcggcacccccaagtacgcccagaagttccaggggcgggtgaccatcacggccgacgagtccaccagcaccgtctacatggagctgtccggcctgcgcagcgaggacaccgcgatgtactactgcgcccggatcccccactacaacttcgggtccggcagctacttcgactactgggggcagggcacgctcgtgaccgtgtccagcgcctccaccaagggccccagcgtcttcccgctggccccctccagcaagtccaccagcgggggcacggcggccctggggtgcctcgtgaaggactacttccccgagcccgtgaccgtcagctggaactccggcgccctgaccagcggcgtgcacaccttcccggccgtgctgcagtccagcgggctctactccctgagctccgtcgtgacggtgcccagctccagcctgggcacccagacctacatctgcaacgtcaaccacaagccctccaacaccaaggtggacaagcgcgtggagcccaagagctgcgacaagacgcacacgtgcccgccctgccccgcccccgagctcctcgggggcccgtccgtcttcctgttcccgcccaagcccaaggacaccctcatgatcagccggacccccgaggtgacctgcgtggtcgtggacgtctcccacgaggaccccgaggtgaagttcaactggtacgtggacggggtcgaggtgcacaacgcgaagaccaagccccgcgaggagcagtacaacagcacctaccgggtggtctccgtgctgaccgtgctgcaccaggactggctcaacggcaaggagtacaagtgcaaggtcagcaacaaggccctgcccgccccgatcgagaagacgatctccaaggccaagggccagccccgcgagccccaggtgtacaccctgcccccgagccgggaggagatgaccaagaaccaggtgagcctgacctgcctggtcaaggggttctacccctccgacatcgccgtggagtgggagagcaacggccagcccgagaacaactacaagacgaccccgcccgtgctggactccgacgggagcttcttcctctactccaagctgaccgtcgacaagagccgctggcagcagggcaacgtgttctcctgcagcgtgatgcacgaggcgctgcacaaccactacacccagaagtccctcagcctgtcccccgggaag

SEQ ID NO: 12917 - RNA, 1359 nt, synthetic construct
  misc_feature 1..1359: note = derived and/or modified sequence opt1 from anti-influenza_Chain
  source 1..1359: mol_type = other RNA
caggtgcagctggtccagagcggcgccgaggtgaagaagcccggggcctccgtgaaggtcagctgcaaggcgtccggctacatcttcaccgggtactacatccactgggtgcgccaggcccccggccaggggctcgagtggatgggccggatcgaccccaacggcagcgggaccacgtacgcccagaagttccagggccgcgtgaccctgaccatggacacctccatcacgaccgcctacatggagctgagccggctccgcttcgacgacaccgccatctactactgcgcgcggtgggactggaacttcgacctgtacctggggtggttcgacccctggggccaggggacccccgtcacggtggcctccgccagcaccaagggcccgtccgtgttccccctcgcccccagctccaagagcacctccggcgggaccgcggccctgggctgcctggtcaaggactacttccccgagccggtgacggtgagctggaactccggggccctcaccagcggcgtccacaccttccccgccgtgctgcagtccagcggcctgtactccctcagcagcgtggtcaccgtgccctccagctccctggggacgcagacctacatctgcaacgtgaaccacaagcccagcaacaccaaggtcgacaagaaggtggagccgaagtcctgcgacaagacccacacgtgcccgccctgccccgcccccgagctgctcggcgggcccagcgtgttcctgttcccgcccaagcccaaggacaccctgatgatctcccgcacccccgaggtgacctgcgtcgtggtcgacgtgagccacgaggaccccgaggtcaagttcaactggtacgtggacggcgtggaggtccacaacgcgaagacgaagccccgggaggagcagtacaactccacctaccgcgtggtgagcgtcctcaccgtgctgcaccaggactggctgaacgggaaggagtacaagtgcaaggtgtccaacaaggccctcccggcccccatcgagaagaccatcagcaaggccaagggccagccccgggagccccaggtctacacgctgccgccctcccgcgaggagatgaccaagaaccaggtgagcctgacctgcctcgtgaagggcttctacccctccgacatcgccgtcgagtgggagagcaacgggcagccggagaacaactacaagaccacgccgcccgtgctggactccgacggcagcttcttcctgtactccaagctcaccgtggacaagagccggtggcagcaggggaacgtcttcagctgctccgtgatgcacgaggcgctgcacaaccactacacccagaagtccctgagcctcagccccggcaag

SEQ ID NO: 12918 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggcctccgtgaaggtcagctgcaaggcgtccggctacatcttcaccgggtactacatccactgggtgcgccaggcccccggccaggggctcgagtggatgggccggatcgaccccaacggcgccgggaccacgtacgcccagaagttccagggccgcgtgaccctgaccatggacaccagcatcacgaccgcctacatggagctgtcccggctccgcttcgacgacaccgcgatctactactgcgcccggtgggactggaacttcgacctgtacctggggtggttcgacccctggggccaggggacccccgtcacggtggccagcgcctccaccaagggcccgagcgtgttccccctcgcgccctccagcaagtccaccagcggcgggaccgccgccctgggctgcctggtcaaggactacttccccgagccggtgacggtgtcctggaacagcggggccctcacctccggcgtccacaccttccccgccgtgctgcagagctccggcctgtacagcctctccagcgtggtcaccgtgcccagctccagcctggggacgcagacctacatctgcaacgtgaaccacaagccctccaacaccaaggtcgacaagaaggtggagcccaagagctgcgacaagacccacacgtgcccgccctgccccgcgccggagctgctcggcgggccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagacgaagccccgggaggagcagtacaacagcacctaccgcgtggtgtccgtcctcaccgtgctgcaccaggactggctgaacgggaaggagtacaagtgcaaggtgagcaacaaggccctcccggcccccatcgagaagaccatctccaaggccaagggccagccccgggagccccaggtctacacgctgccgcccagccgcgaggagatgaccaagaaccaggtgtccctgacctgcctcgtgaagggcttctaccccagcgacatcgcggtcgagtgggagtccaacgggcagccggagaacaactacaagaccacgccgcccgtgctggacagcgacggctccttcttcctgtacagcaagctcaccgtggacaagtcccggtggcagcaggggaacgtcttcagctgcagcgtgatgcacgaggccctgcacaaccactacacccagaagtccctgagcctctcccccggcaag

SEQ ID NO: 12919 - RNA, 1359 nt, synthetic construct
  misc_feature 1..1359: note = derived and/or modified sequence opt1 from anti-influenza_Chain
  source 1..1359: mol_type = other RNA
caggtgcagctggtccagagcggcgccgaggtgaagaagcccggggcctccgtgaaggtcagctgcaaggcgtccggctacaccttcaacgcccaccacatgcactgggtgcgccaggccccggggcagggcctcgggtggatgggctggatcgaccccaacaacgacggcaccatctacgcccagaagttccaggggcgggtgacgctgaccatggacaccagcatccacaccgcctacatggagctgtccggcctccgctacgacgacacggcgatctactactgcgtccggtgggcctggaacttcgacttcttcctggggtggttcgacccctggggccaggggaccctggtgaccgtggccagcgcctccaccaagggccccagcgtcttcccgctcgcgccctccagcaagtccacgagcggcgggaccgccgccctgggctgcctggtgaaggactacttccccgagcccgtgaccgtctcctggaacagcggggccctcacctccggcgtgcacacgttcccggccgtgctgcagagctccggcctgtacagcctctccagcgtcgtgaccgtgcccagctccagcctggggacccagacctacatctgcaacgtcaaccacaagccctccaacacgaaggtggacaagaaggtggagcccaagagctgcgacaagacccacacgtgcccgccctgccccgcgcccgagctgctcggcgggccgtccgtcttcctgttcccgcccaagcccaaggacaccctgatgatcagccgcacccccgaggtgacctgcgtggtcgtggacgtctcccacgaggaccccgaggtgaagttcaactggtacgtggacggcgtcgaggtgcacaacgccaagaccaagccccgggaggagcagtacaacagcacctaccgcgtggtctccgtgctcacggtgctgcaccaggactggctgaacgggaaggagtacaagtgcaaggtcagcaacaaggccctccccgccccgatcgagaagaccatctccaaggccaagggccagccccgggagccccaggtgtacaccctgcccccgagccgcgaggagatgaccaagaaccaggtgtccctgacgtgcctcgtcaagggcttctaccccagcgacatcgcggtggagtgggagtccaacgggcagcccgagaacaactacaagaccaccccgcccgtgctggacagcgacggctccttcttcctgtacagcaagctcaccgtcgacaagtcccggtggcagcaggggaacgtgttcagctgcagcgtgatgcacgaggccctgcacaaccactacacgcagaagtccctgagcctctcccccggcaag

SEQ ID NO: 12920 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgacagcgacaccatctactcccccagcttccagggccaggtgacgatctccgccgacaacagcatctccaccgcgtacctgcagtggagctccctcaaggccagcgacaccgccatctactactgcgcctccgggcccgggtacagcggctaccactacgggtggttcgacacctggggccagggcacgctggtgaccgtctccagcgcctccaccaaggggccgagcgtgttccccctggcgcccagctccaagagcacctccggcgggacggccgccctcggctgcctggtgaaggactacttccccgagccggtcaccgtgagctggaactccggcgccctgaccagcggggtgcacaccttccccgcggtcctccagtccagcggcctgtactccctgagctccgtggtgacggtccccagctccagcctcgggacccagacctacatctgcaacgtgaaccacaagccctccaacaccaaggtggacaagaaggtcgagcccaagagctgcgacaagacgcacacgtgcccgccctgccccgccccggagctgctgggcgggccctccgtgttcctcttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacctaccgggtcgtgagcgtgctgaccgtcctccaccaggactggctgaacggcaaggagtacaagtgcaaggtgtccaacaaggccctgccggcccccatcgagaagacgatcagcaaggcgaaggggcagccccgcgagccccaggtgtacaccctcccgccctcccgggaggagatgaccaagaaccaggtcagcctgacctgcctggtgaagggcttctacccctccgacatcgccgtggagtgggagagcaacgggcagccggagaacaactacaagacgaccccgcccgtcctcgactccgacggcagcttcttcctgtactccaagctgaccgtggacaagagccgctggcagcaggggaacgtgttctcctgcagcgtcatgcacgaggccctccacaaccactacacccagaagtccctgagcctgtcccccggcaag

SEQ ID NO: 12921 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgacgccgacgcgatctacagcccctccttccagggccaggtgaccatcagcgccgacaactccatcagcacggcctacctgcagtggtccagcctcaaggcctccgacaccgccatctactactgcgcgagcgggcccgggtactccggctaccactacgggtggttcgacacctggggccagggcaccctggtgacggtcagctccgccagcaccaaggggccgtccgtgttccccctggcccccagcagcaagtccaccagcggcgggaccgccgcgctcggctgcctggtgaaggactacttccccgagccggtcacggtgtcctggaacagcggcgccctgacctccggggtgcacaccttccccgccgtcctccagagctccggcctgtacagcctgtccagcgtggtgaccgtcccctccagctccctcgggacgcagacctacatctgcaacgtgaaccacaagcccagcaacaccaaggtggacaagaaggtcgagccgaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagacgaagccccgcgaggagcagtacaactccacctaccgggtcgtgagcgtgctgaccgtcctccaccaggactggctgaacggcaaggagtacaagtgcaaggtgagcaacaaggcgctgccggcccccatcgagaagaccatctccaaggccaaggggcagccccgcgagccccaggtgtacacgctcccgcccagccgggaggagatgaccaagaaccaggtctccctgacctgcctggtgaagggcttctaccccagcgacatcgccgtggagtgggagtccaacgggcagccggagaacaactacaagaccacgccgcccgtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 12922 - RNA, 1359 nt, synthetic construct; identical to SEQ ID NO: 8665
  misc_feature 1..1359: note = derived and/or modified sequence opt1 from anti-influenza_Chain
  source 1..1359: mol_type = other RNA

SEQ ID NO: 12923 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgacgccgacaccatctacagcccctccttccagggccaggtgacgatcagcgcggacaactccatcagcaccgcctacctgcagtggtccagcctcaaggcctccgacaccgccatctactactgcgccagcgggcccgggtactccggctaccactacgggtggttcgacacctggggccagggcacgctggtgaccgtcagctccgcgagcaccaaggggccgtccgtgttccccctggcccccagcagcaagtccaccagcggcgggacggccgccctcggctgcctggtgaaggactacttccccgagccggtcaccgtgtcctggaacagcggcgcgctgacctccggggtgcacaccttccccgccgtcctccagagctccggcctgtacagcctgtccagcgtggtgacggtcccctccagctccctcgggacccagacctacatctgcaacgtgaaccacaagcccagcaacaccaaggtggacaagaaggtcgagccgaagtcctgcgacaagacgcacacgtgcccgccctgccccgcccccgagctgctgggcgggcccagcgtgttcctcttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagaccaagccccgcgaggagcagtacaactccacctaccgggtcgtgagcgtgctgaccgtcctccaccaggactggctgaacggcaaggagtacaagtgcaaggtgagcaacaaggccctgccggcgcccatcgagaagacgatctccaaggccaaggggcagccccgcgagccccaggtgtacaccctcccgcccagccgggaggagatgaccaagaaccaggtctccctgacctgcctggtgaagggcttctaccccagcgacatcgccgtggagtgggagtccaacgggcagccggagaacaactacaagacgaccccgcccgtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 12924 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcagctccgacaccatctacagcccctccttccagggccaggtgacgatcagcgccgacaactccatcagcaccgcgtacctgcagtggtccagcctcaaggcctccgacaccgccatctactactgcgccagcgggcccgggtactccggctaccactacgggtggttcgacacctggggccagggcacgctggtgaccgtcagctccgccagcaccaaggggccgagcgtgttccccctggcgccctccagcaagtccaccagcggcgggacggccgccctcggctgcctggtgaaggactacttccccgagccggtcaccgtgtcctggaacagcggcgccctgacctccggggtgcacaccttccccgcggtcctccagagctccggcctgtacagcctgtccagcgtggtgacggtcccctccagctccctcgggacccagacctacatctgcaacgtgaaccacaagcccagcaacaccaaggtggacaagaaggtcgagccgaagtcctgcgacaagacgcacacgtgcccgccctgccccgcccccgagctgctgggcgggcccagcgtgttcctcttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagaccaagccccgcgaggagcagtacaacagcacctaccgggtcgtgtccgtgctgaccgtcctccaccaggactggctgaacggcaaggagtacaagtgcaaggtgagcaacaaggccctgccggcccccatcgagaagacgatctccaaggcgaaggggcagccccgcgagccccaggtgtacaccctcccgcccagccgggaggagatgaccaagaaccaggtctccctgacctgcctggtgaagggcttctaccccagcgacatcgccgtggagtgggagtccaacgggcagccggagaacaactacaagacgaccccgcccgtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 12925 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgacagcgacgccatctactcccccagcttccagggccaggtgaccatctccgcggacaacagcatctccacggcctacctgcagtggagctccctcaaggccagcgacaccgccatctactactgcgcctccgggcccgggtacagcggctaccactacgggtggttcgacacctggggccagggcaccctggtgacggtctccagcgcgtccaccaaggggccgagcgtgttccccctggcccccagctccaagagcacctccggcgggaccgccgccctcggctgcctggtgaaggactacttccccgagccggtcacggtgagctggaactccggcgcgctgaccagcggggtgcacaccttccccgccgtcctccagtccagcggcctgtactccctgagctccgtggtgaccgtccccagctccagcctcgggacgcagacctacatctgcaacgtgaaccacaagccctccaacaccaaggtggacaagaaggtcgagcccaagagctgcgacaagacccacacgtgcccgccctgccccgccccggagctgctgggcgggccctccgtgttcctcttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagacgaagccccgcgaggagcagtacaacagcacctaccgggtcgtgagcgtgctgaccgtcctccaccaggactggctgaacggcaaggagtacaagtgcaaggtgtccaacaaggccctgccggcgcccatcgagaagaccatcagcaaggccaaggggcagccccgcgagccccaggtgtacacgctcccgccctcccgggaggagatgaccaagaaccaggtcagcctgacctgcctggtgaagggcttctacccctccgacatcgccgtggagtgggagagcaacgggcagccggagaacaactacaagaccacgccgcccgtcctcgactccgacggcagcttcttcctgtactccaagctgaccgtggacaagagccgctggcagcaggggaacgtgttctcctgcagcgtcatgcacgaggccctccacaaccactacacccagaagtccctgagcctgtcccccggcaag

SEQ ID NO: 12926 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgacaccgacacgatctacagcccctccttccagggccaggtgaccatcagcgccgacaactccatcagcaccgcgtacctgcagtggtccagcctcaaggcctccgacaccgccatctactactgcgccagcgggcccgggtactccggctaccactacgggtggttcgacacgtggggccagggcaccctggtgaccgtcagctccgccagcaccaaggggccgtccgtgttccccctggcgcccagcagcaagtccacgagcggcgggaccgccgccctcggctgcctggtgaaggactacttccccgagccggtcaccgtgtcctggaacagcggcgccctgacctccggggtgcacacgttccccgcggtcctccagagctccggcctgtacagcctgtccagcgtggtgaccgtcccctccagctccctcgggacccagacctacatctgcaacgtgaaccacaagcccagcaacacgaaggtggacaagaaggtcgagccgaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagaccaagccccgcgaggagcagtacaactccacctaccgggtcgtgagcgtgctgacggtcctccaccaggactggctgaacggcaaggagtacaagtgcaaggtgagcaacaaggccctgccggcccccatcgagaagaccatctccaaggcgaaggggcagccccgcgagccccaggtgtacaccctcccgcccagccgggaggagatgaccaagaaccaggtctccctgacgtgcctggtgaagggcttctaccccagcgacatcgccgtggagtgggagtccaacgggcagccggagaacaactacaagaccaccccgcccgtcctcgacagcgacggctccttcttcctgtacagcaagctgaccgtggacaagtcccgctggcagcaggggaacgtgttcagctgctccgtcatgcacgaggccctccacaaccactacacgcagaagtccctgagcctgagccccggcaag

SEQ ID NO: 12927 - RNA, 1359 nt, synthetic construct
  misc_feature 1..1359: note = derived and/or modified sequence opt1 from anti-influenza_Chain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgagagcgacaccatctactcccccagcttccagggccaggtgacgatctccgccgacaacagcatctccaccgcgtacctgcagtggagctccctcaaggccagcgacaccgccatctactactgcgcctccgggcccgggtacagcggctaccactacgggtggttcgacacctggggccagggcacgctggtgaccgtctccagcgcctccaccaaggggccgagcgtgttccccctggcgcccagctccaagagcacctccggcgggacggccgccctcggctgcctggtgaaggactacttccccgagccggtcaccgtgagctggaactccggcgccctgaccagcggggtgcacaccttccccgcggtcctccagtccagcggcctgtactccctgagctccgtggtgacggtccccagctccagcctcgggacccagacctacatctgcaacgtgaaccacaagccctccaacaccaaggtggacaagaaggtcgagcccaagagctgcgacaagacgcacacgtgcccgccctgccccgccccggagctgctgggcgggccctccgtgttcctcttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacctaccgggtcgtgagcgtgctgaccgtcctccaccaggactggctgaacggcaaggagtacaagtgcaaggtgtccaacaaggccctgccggcccccatcgagaagacgatcagcaaggcgaaggggcagccccgcgagccccaggtgtacaccctcccgccctcccgggaggagatgaccaagaaccaggtcagcctgacctgcctggtgaagggcttctacccctccgacatcgccgtggagtgggagagcaacgggcagccggagaacaactacaagacgaccccgcccgtcctcgactccgacggcagcttcttcctgtactccaagctgaccgtggacaagagccgctggcagcaggggaacgtgttctcctgcagcgtcatgcacgaggccctccacaaccactacacccagaagtccctgagcctgtcccccggcaag

SEQ ID NO: 12928 - RNA, 1359 nt, synthetic construct; identical to SEQ ID NO: 12916
  misc_feature 1..1359: note = derived and/or modified sequence opt1 from anti-influenza_Chain
  source 1..1359: mol_type = other RNA

SEQ ID NO: 12929 - RNA, 1359 nt, synthetic construct; identical to SEQ ID NO: 12917
  misc_feature 1..1359: note = derived and/or modified sequence opt1 from anti-influenza_Chain
  source 1..1359: mol_type = other RNA

SEQ ID NO: 12930 - RNA, 1359 nt, synthetic construct; identical to SEQ ID NO: 12918
  misc_feature 1..1359: note = derived and/or modified sequence opt1 from anti-influenza_Chain
  source 1..1359: mol_type = other RNA

SEQ ID NO: 12931 - RNA, 1359 nt, synthetic construct; identical to SEQ ID NO: 12919
  misc_feature 1..1359: note = derived and/or modified sequence opt1 from anti-influenza_Chain
  source 1..1359: mol_type = other RNA

SEQ ID NO: 12932 - RNA, 1359 nt, synthetic construct; identical to SEQ ID NO: 12920
  misc_feature 1..1359: note = derived and/or modified sequence opt1 from anti-influenza_Chain
  source 1..1359: mol_type = other RNA

SEQ ID NO: 12933 - RNA, 1359 nt, synthetic construct; identical to SEQ ID NO: 12921
  misc_feature 1..1359: note = derived and/or modified sequence opt1 from anti-influenza_Chain
  source 1..1359: mol_type = other RNA

SEQ ID NO: 12934 - RNA, 1359 nt, synthetic construct; identical to SEQ ID NO: 8665
  misc_feature 1..1359: note = derived and/or modified sequence opt1 from anti-influenza_Chain
  source 1..1359: mol_type = other RNA

SEQ ID NO: 12935 - RNA, 1359 nt, synthetic construct; identical to SEQ ID NO: 12923
  misc_feature 1..1359: note = derived and/or modified sequence opt1 from anti-influenza_Chain
  source 1..1359: mol_type = other RNA

SEQ ID NO: 12936 - RNA, 1359 nt, synthetic construct; identical to SEQ ID NO: 12924
  misc_feature 1..1359: note = derived and/or modified sequence opt1 from anti-influenza_Chain
  source 1..1359: mol_type = other RNA

SEQ ID NO: 12937 - RNA, 1359 nt, synthetic construct; identical to SEQ ID NO: 12925
  misc_feature 1..1359: note = derived and/or modified sequence opt1 from anti-influenza_Chain
  source 1..1359: mol_type = other RNA

SEQ ID NO: 12938 - RNA, 1359 nt, synthetic construct; identical to SEQ ID NO: 12926
  misc_feature 1..1359: note = derived and/or modified sequence opt1 from anti-influenza_Chain
  source 1..1359: mol_type = other RNA

SEQ ID NO: 12939 - RNA, 1359 nt, synthetic construct; identical to SEQ ID NO: 12927
  misc_feature 1..1359: note = derived and/or modified sequence opt1 from anti-influenza_Chain
  source 1..1359: mol_type = other RNA

SEQ ID NO: 12940 - RNA, 1365 nt, synthetic construct
  misc_feature 1..1365: note = derived and/or modified sequence opt1 from anti-influenza_Chain
  source 1..1365: mol_type = other RNA
caggtgcagctggtcgagagcggcgggggcgtggtgcagcccgggcgctccctccggctgagctgcgccgcctccggcttcgcgttccacaaccgcgccatgcactgggtccggcaggccccggggaagggcctggagtgggtggccctcatctacttcgacggcagcaagcagtactacgccgactccgtgaaggggcgcttcaccatcagccgggacaactccaagaacaccgtcttcctgcagatgaacagcctgcgccccgaggacaccgcggtgtactactgcgccgtgcccggccccatcttcgggatcttcccgccctggtcctacttcgaccactggggccaggggatcctcgtcaccgtgagctccgccagcaccaagggcccctccgtgttccccctggccccgagctccaagagcacctccggcgggacggcggccctgggctgcctcgtcaaggactacttccccgagcccgtgaccgtgagctggaactccggggccctgaccagcggcgtccacaccttccccgccgtgctgcagagctccggcctctacagcctgtccagcgtggtcacggtgccgtccagctccctggggacccagacctacatctgcaacgtgaaccacaagcccagcaacaccaaggtcgacaagaaggtggagcccaagtcctgcgacaagacgcacacgtgcccgccctgccccgcccccgagctcctgggcgggcccagcgtgttcctgttcccgcccaagcccaaggacaccctcatgatctcccggacccccgaggtgacctgcgtcgtcgtggacgtgagccacgaggacccggaggtcaagttcaactggtacgtggacggcgtggaggtccacaacgcgaagaccaagccccgcgaggagcagtacaactccacctaccgggtggtgagcgtcctgaccgtgctgcaccaggactggctcaacgggaaggagtacaagtgcaaggtgtccaacaaggccctgcccgcccccatcgagaagacgatcagcaaggccaagggccagccgcgcgagccccaggtctacaccctgcccccgtcccgggaggagatgaccaagaaccaggtgagcctgacctgcctcgtgaagggcttctacccctccgacatcgccgtcgagtgggagagcaacgggcagcccgagaacaactacaagacgacgcccccggtgctggacagcgacggctccttcttcctctacagcaagctgaccgtggacaagtcccgctggcagcaggggaacgtcttcagctgctccgtgatgcacgaggcgctgcacaaccactacacccagaagtccctcagcctgagccccggcaag

SEQ ID NO: 12941 - RNA, 1365 nt, synthetic construct
  misc_feature 1..1365: note = derived and/or modified sequence opt1 from anti-influenza_Chain
  source 1..1365: mol_type = other RNA
gaggtgcagctggtcgagagcggcgggggcgtggtgcagcccgggcgctccctccggctgagctgcgccgcctccggcttcgcgttccacaaccgcgccatgcactgggtccggcaggccccggggaagggcctggagtgggtggccctcatctacttcgacggcagcaagcagtactacgccgactccgtgaaggggcgcttcaccatcagccgggacaactccaagaacaccgtcttcctgcagatgaacagcctgcgccccgaggacaccgcggtgtactactgcgccgtgcccggccccatcttcgggatcttcccgccctggtcctacttcgaccactggggccaggggatcctcgtcaccgtgagctccgccagcaccaagggcccctccgtgttccccctggccccgagctccaagagcacctccggcgggacggcggccctgggctgcctcgtcaaggactacttccccgagcccgtgaccgtgagctggaactccggggccctgaccagcggcgtccacaccttccccgccgtgctgcagagctccggcctctacagcctgtccagcgtggtcacggtgccgtccagctccctggggacccagacctacatctgcaacgtgaaccacaagcccagcaacaccaaggtcgacaagaaggtggagcccaagtcctgcgacaagacgcacacgtgcccgccctgccccgcccccgagctcctgggcgggcccagcgtgttcctgttcccgcccaagcccaaggacaccctcatgatctcccggacccccgaggtgacctgcgtcgtcgtggacgtgagccacgaggacccggaggtcaagttcaactggtacgtggacggcgtggaggtccacaacgcgaagaccaagccccgcgaggagcagtacaactccacctaccgggtggtgagcgtcctgaccgtgctgcaccaggactggctcaacgggaaggagtacaagtgcaaggtgtccaacaaggccctgcccgcccccatcgagaagacgatcagcaaggccaagggccagccgcgcgagccccaggtctacaccctgcccccgtcccgggaggagatgaccaagaaccaggtgagcctgacctgcctcgtgaagggcttctacccctccgacatcgccgtcgagtgggagagcaacgggcagcccgagaacaactacaagacgacgcccccggtgctggacagcgacggctccttcttcctctacagcaagctgaccgtggacaagtcccgctggcagcaggggaacgtcttcagctgctccgtgatgcacgaggcgctgcacaaccactacacccagaagtccctcagcctgagccccggcaag

SEQ ID NO: 12942 - RNA, 1365 nt, synthetic construct
  misc_feature 1..1365: note = derived and/or modified sequence opt1 from anti-influenza_Chain
  source 1..1365: mol_type = other RNA
gaggtgcagctggtccagagcggcgggggcgtggtgcagcccgggaagtccctccgcctgagctgcgccgcctccggcctgaccttcagctcctacgcggtccactgggtgcggcaggccccggggaagggcctcgagtgggtgaccctgatcagctacgacggcgccaaccagtactacgccgactccgtcaaggggcgcttcacgatcagccgggacaactccaagaacaccgtgtacctgcagatgaacagcctccgccccgaggacaccgccgtgtactactgcgcggtccccggccccgtgttcgggatcttcccgccctggtcctacttcgacaactggggccaggggatcctggtgaccgtcagctccgccagcacgaagggcccctccgtgttccccctggccccgagctccaagagcacctccggcgggaccgccgcgctcggctgcctggtgaaggactacttccccgagcccgtcaccgtgagctggaacagcggggccctgacgtccggcgtgcacaccttccccgccgtcctccagagctccggcctgtacagcctgtccagcgtggtgaccgtcccgtccagctccctcgggacccagacgtacatctgcaacgtgaaccacaagcccagcaacaccaaggtggacaagaaggtcgagcccaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtcgacgtgagccacgaggacccggaggtgaagttcaactggtacgtcgacggcgtggaggtgcacaacgccaagaccaagccccgcgaggagcagtacaactccacgtaccgggtcgtgagcgtgctgaccgtcctccaccaggactggctgaacgggaaggagtacaagtgcaaggtgtccaacaaggcgctgcccgcccccatcgagaagaccatcagcaaggccaagggccagccgcgcgagccccaggtgtacaccctcccgccctcccgggaggagatgacgaagaaccaggtcagcctgacctgcctggtgaagggcttctaccccagcgacatcgccgtggagtgggagtccaacgggcagcccgagaacaactacaagaccacgcccccggtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 12943 - RNA, 1365 nt, synthetic construct
  misc_feature 1..1365: note = derived and/or modified sequence opt1 from anti-influenza_Chain
  source 1..1365: mol_type = other RNA
caggtgcagctggtcgagagcggcgggggcgtggtgcagcccgggaagtccctccgcctgagctgcgccgcctccggcctgaccttcagctcctacgcggtccactgggtgcggcaggccccggggaagggcctcgagtgggtgaccctgatcagctacgacggcgccaaccagtactacgccgactccgtcaaggggcgcttcacgatcagccgggacaactccaagaacaccgtgtacctgcagatgaacagcctccgccccgaggacaccgccgtgtactactgcgcggtccccggccccgtgttcgggatcttcccgccctggtcctacttcgacaactggggccaggggatcctggtgaccgtcagctccgccagcacgaagggcccctccgtgttccccctggccccgagctccaagagcacctccggcgggaccgccgcgctcggctgcctggtgaaggactacttccccgagcccgtcaccgtgagctggaacagcggggccctgacgtccggcgtgcacaccttccccgccgtcctccagagctccggcctgtacagcctgtccagcgtggtgaccgtcccgtccagctccctcgggacccagacgtacatctgcaacgtgaaccacaagcccagcaacaccaaggtggacaagaaggtcgagcccaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtcgacgtgagccacgaggacccggaggtgaagttcaactggtacgtcgacggcgtggaggtgcacaacgccaagaccaagccccgcgaggagcagtacaactccacgtaccgggtcgtgagcgtgctgaccgtcctccaccaggactggctgaacgggaaggagtacaagtgcaaggtgtccaacaaggcgctgcccgcccccatcgagaagaccatcagcaaggccaagggccagccgcgcgagccccaggtgtacaccctcccgccctcccgggaggagatgacgaagaaccaggtcagcctgacctgcctggtgaagggcttctaccccagcgacatcgccgtggagtgggagtccaacgggcagcccgagaacaactacaagaccacgcccccggtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 12944 - RNA, 1365 nt, synthetic construct
  misc_feature 1..1365: note = derived and/or modified sequence opt1 from anti-influenza_Chain
  source 1..1365: mol_type = other RNA
caggtgcagctggtcgagagcggcgggggcgtggtgcagcccgggaagtccccgcgcctcagctgcgccgcctccggccccaccttcagctcctacgcggtccactgggtgcggcaggcccccgggaagggcctggagtgggtgaccctgatcagctacgacggcgccaaccagtactacgccgactccgtcaaggggcgcttcacgatcagccgggacaactccaagaacaccgtgtacctccagatgaacagcctgcgccccgaggacaccgccgtgtactactgcgcggtccccggccccgtgttcgggatcttcccgccctggtcctacttcgacaactggggccaggggatcctggtgaccgtcagctccgccagcacgaagggcccgtccgtgttccccctcgcccccagctccaagagcacctccggcgggaccgccgcgctgggctgcctggtgaaggactacttccccgagccggtcaccgtgagctggaacagcggggccctcacgtccggcgtgcacaccttccccgccgtcctgcagagctccggcctgtacagcctctccagcgtggtgaccgtcccctccagctccctggggacccagacgtacatctgcaacgtgaaccacaagcccagcaacaccaaggtggacaagaaggtcgagccgaagtcctgcgacaagacccacacgtgcccgccctgccccgcccccgagctgctcggcgggcccagcgtgttcctgttcccgcccaagcccaaggacaccctgatgatctcccggacccccgaggtgacctgcgtcgtggtcgacgtgagccacgaggaccccgaggtgaagttcaactggtacgtcgacggcgtggaggtgcacaacgccaagaccaagccccgcgaggagcagtacaactccacgtaccgggtcgtgagcgtgctcaccgtcctgcaccaggactggctgaacgggaaggagtacaagtgcaaggtgtccaacaaggcgctcccggcccccatcgagaagaccatcagcaaggccaagggccagccccgcgagccccaggtgtacaccctgccgccctcccgggaggagatgacgaagaaccaggtcagcctgacctgcctcgtgaagggcttctaccccagcgacatcgccgtggagtgggagtccaacgggcagcccgagaacaactacaagaccaccccgcccgtcctggacagcgacggctccttcttcctgtacagcaagctcacggtggacaagtcccgctggcagcaggggaacgtgttcagctgctccgtcatgcacgaggccctgcacaaccactacacccagaagtccctgagcctcagccccggcaag

SEQ ID NO: 12945 - RNA, 1365 nt, synthetic construct; identical to SEQ ID NO: 8649
  misc_feature 1..1365: note = derived and/or modified sequence opt1 from anti-influenza_Chain
  source 1..1365: mol_type = other RNA

SEQ ID NO: 12946 - RNA, 1365 nt, synthetic construct
  misc_feature 1..1365: note = derived and/or modified sequence opt1 from anti-influenza_Chain
  source 1..1365: mol_type = other RNA
caggtgcagctggtccagagcggcgccgagctcaagcgccccggggcctccgtgaaggtgagctgcaagacctccggctacagcttcaacaactacgggatcaactgggtccggcaggcgccgggccaggggctggagtggatgggctggatctccgcctacaccggcaacacccactacgccaagaacttcgaggggcgcgtgaccctgaccaccgacacgagcacctccaccgcctacatggaggtgcggagcctccgctccgacgacagcgccgtctacttctgcgcgcgggccatgatccagggcgtggtgaccctgtacctgcgccccggggactactggggccaggggacgctcgtcaccgtgtccagcgcctccaccaagggccccagcgtgttccccctggccccgtccagcaagtccaccagcggcgggacggcggccctgggctgcctcgtcaaggactacttccccgagcccgtgaccgtgtcctggaacagcggggccctgaccagcggcgtccacaccttccccgccgtgctgcagtccagcggcctctactccctgagctccgtggtcacggtgccgagctccagcctggggacccagacctacatctgcaacgtgaaccacaagccctccaacaccaaggtcgacaagaaggtggagcccaagagctgcgacaagacgcacacgtgcccgccctgccccgcccccgagctcctgggcgggccctccgtgttcctgttcccgcccaagcccaaggacaccctcatgatcagccggacccccgaggtgacctgcgtcgtcgtggacgtgtcccacgaggacccggaggtcaagttcaactggtacgtggacggcgtggaggtccacaacgcgaagaccaagccccgcgaggagcagtacaacagcacctaccgggtggtgtccgtcctgaccgtgctgcaccaggactggctcaacgggaaggagtacaagtgcaaggtgagcaacaaggccctgcccgcccccatcgagaagacgatctccaaggccaagggccagccgcgcgagccccaggtctacaccctgccgcccagccgggaggagatgaccaagaaccaggtgtccctgacctgcctcgtgaagggcttctaccccagcgacatcgccgtcgagtgggagagcaacgggcagcccgagaacaactacaagacgacgcccccggtgctggactccgacggcagcttcttcctctactccaagctgaccgtggacaagagccgctggcagcaggggaacgtcttctcctgcagcgtgatgcacgaggcgctgcacaaccactacacccagaagtccctcagcctgtcccccggcaag

SEQ ID NO: 12947 - RNA, 1365 nt, synthetic construct; identical to SEQ ID NO: 12940
  misc_feature 1..1365: note = derived and/or modified sequence opt1 from anti-influenza_Chain
  source 1..1365: mol_type = other RNA

SEQ ID NO: 12948 - RNA, 1365 nt, synthetic construct; identical to SEQ ID NO: 12941
  misc_feature 1..1365: note = derived and/or modified sequence opt1 from anti-influenza_Chain
  source 1..1365: mol_type = other RNA

SEQ ID NO: 12949 - RNA, 1365 nt, synthetic construct; identical to SEQ ID NO: 12942
  misc_feature 1..1365: note = derived and/or modified sequence opt1 from anti-influenza_Chain
  source 1..1365: mol_type = other RNA

SEQ ID NO: 12950 - RNA, 1365 nt, synthetic construct; identical to SEQ ID NO: 12943
  misc_feature 1..1365: note = derived and/or modified sequence opt1 from anti-influenza_Chain
  source 1..1365: mol_type = other RNA

SEQ ID NO: 12951 - RNA, 1365 nt, synthetic construct; identical to SEQ ID NO: 12944
  misc_feature 1..1365: note = derived and/or modified sequence opt1 from anti-influenza_Chain
  source 1..1365: mol_type = other RNA

SEQ ID NO: 12952 - RNA, 1365 nt, synthetic construct; identical to SEQ ID NO: 8649
  misc_feature 1..1365: note = derived and/or modified sequence opt1 from anti-influenza_Chain
  source 1..1365: mol_type = other RNA

SEQ ID NO: 12953 - RNA, 1365 nt, synthetic construct; identical to SEQ ID NO: 12946
  misc_feature 1..1365: note = derived and/or modified sequence opt1 from anti-influenza_Chain
  source 1..1365: mol_type = other RNA

SEQ ID NO: 12954 - RNA, 1368 nt, synthetic construct
  misc_feature 1..1368: note = derived and/or modified sequence opt1 from anti-influenza_Chain
  source 1..1368: mol_type = other RNA
gaggtgcagctggtccagagcggcgggggcgtggtgcagccccgccggtccctccgcctgagctgcgccgcctccgggttcaccttcagctcctacgcgatgcactgggtccggcaggccccgggcaaggggctggagtgggtggccgtgatcagctacgacggccgcaacaagtactacgccgactccgtcaagggccggttcaccgtgagccgcgacaactccaagaacacgctctacctgcagatgaacagcctgcgggccgaggacacctccgtgtactactgcgcgcgcgagctcctgatggactactacgaccacatcgggtacagccccggccccacctgggggcagggcaccctggtcacggtgtccagcgcctccaccaaggggcccagcgtgttcccgctcgccccctccagcaagtccaccagcggcggcaccgccgcgctggggtgcctggtcaaggactacttccccgagcccgtgacggtgagctggaactccggcgccctcaccagcggggtccacaccttcccggccgtgctgcagtccagcggcctgtactccctcagctccgtggtcaccgtgcccagctccagcctgggcacgcagacctacatctgcaacgtgaaccacaagccctccaacaccaaggtcgacaagcgggtggagcccaagagctgcgacaagacccacacgtgcccgccctgccccgcccccgagctgctcgggggcccgtccgtgttcctgttcccgcccaagcccaaggacaccctgatgatcagccgcacccccgaggtgacctgcgtcgtcgtggacgtgtcccacgaggaccccgaggtcaagttcaactggtacgtggacggggtggaggtccacaacgccaagacgaagccccgggaggagcagtacaacagcacctaccgcgtggtgtccgtcctcaccgtgctgcaccaggactggctgaacggcaaggagtacaagtgcaaggtgagcaacaaggcgctccccgccccgatcgagaagaccatctccaaggccaaggggcagccccgggagccccaggtctacacgctgcccccgagccgcgaggagatgaccaagaaccaggtgagcctgacctgcctcgtgaagggcttctacccctccgacatcgccgtcgagtgggagagcaacggccagcccgagaacaactacaagaccacgccgcccgtgctggactccgacgggagcttcttcctgtactccaagctcaccgtggacaagagccggtggcagcagggcaacgtcttctcctgcagcgtgatgcacgaggccctgcacaaccactacacccagaagtccctgagcctctcccccgggaag

SEQ ID NO: 12955 - RNA, 1371 nt, synthetic construct
  misc_feature 1..1371: note = derived and/or modified sequence opt1 from anti-influenza_Chain
  source 1..1371: mol_type = other RNA
atggtgatccagcgcaacagcatcctgctcctgatcatcatcttcgcctccagcatctccacgtgccggagcaacgtcatcgacgacaacctgttcaagcaggtctacgacaacatcctcgagcaggagttcgcccacgacttccaggcctacctgtcctacctgagcaagaacatcgagtccaacaacaacatcgacaaggtggacaagaacggcatcaaggtgatcaacgtgctcagcttcggggccaagggcgacgggaagacctacgacaacatcgccttcgagcaggcctggaacgaggcctgctccagccgcacccccgtgcagttcgtcgtgccgaagaacaagaactacctgctgaagcagatcaccttctccggcccctgccggagctccatcagcgtgaagatcttcgggtccctcgaggcgagctccaagatcagcgactacaaggaccgccggctgtggatcgccttcgactccgtccagaacctggtggtgggcggcgggggcaccatcaacgggaacggccaggtctggtggcccagcagctgcaagatcaacaagtccctcccctgccgcgacgccccgaccgccctgaccttctggaactgcaagaacctgaaggtgaacaacctcaagagcaagaacgcgcagcagatccacatcaagttcgagtcctgcaccaacgtggtcgccagcaacctgatgatcaacgcctccgccaagagccccaacaccgacggggtgcacgtgtccaacacccagtacatccagatcagcgacacgatcatcggcaccggcgacgactgcatctccatcgtcagcgggtcccagaacgtgcaggccaccaacatcacgtgcggccccgggcacggcatcagcatcggctccctggggagcggcaactccgaggcgtacgtgagcaacgtcaccgtgaacgaggccaagatcatcggggccgagaacggcgtgcggatcaagacctggcagggcgggtccggccaggccagcaacatcaagttcctcaacgtcgagatgcaggacgtgaagtaccccatcatcatcgaccagaactactgcgaccgcgtcgagccgtgcatccagcagttctccgccgtccaggtgaagaacgtggtgtacgagaacatcaaggggaccagcgcgaccaaggtggccatcaagttcgactgcagcacgaacttcccctgcgagggcatcatcatggagaacatcaacctggtcggggagtccggcaagcccagcgaggcgacctgcaagaacgtgcacttcaacaacgccgagcacgtgacgccccactgcacctccctggagatcagcgaggacgaggccctcctgtacaactac

SEQ ID NO: 12956 - RNA, 1371 nt, synthetic construct; identical to SEQ ID NO: 12955
  misc_feature 1..1371: note = derived and/or modified sequence opt1 from anti-influenza_Chain
  source 1..1371: mol_type = other RNA

SEQ ID NO: 12957 - RNA, 1380 nt, synthetic construct
  misc_feature 1..1380: note = derived and/or modified sequence opt1 from anti-influenza_Chain
  source 1..1380: mol_type = other RNA
atgaagctgtggctcaactggatcttcctggtgaccctgctcaacgacatccagtgcgaggtcaagctggtggagagcggcgggggcctggtgcagcccgggggctccctccgcctgagctgcgccacctccgggttcaccttcagcgactactacatgtcctgggtccggcagagcccgggcaaggccctggagtggctcggcttcacccgctcccgggtgctggggtacaccaccgactacagcgcgtccgtgaagggccgcttcacgatcagccgggacaactcccagagcatcctgtacctccagatgaactccctgcgcggggaggacagcgccacctactactgcgcccgggaccgccccatggactactggggccaggggacctccgtcaccgtgagctccgccaagacgaccccgcccagcgtgtaccccctggcccccggctccgcggcccagaccaacagcatggtcaccctcggctgcctggtgaaggggtacttccccgagcccgtgacggtcacctggaacagcggctccctgagctccggggtgcacaccttcccggccgtgctccagagcgacctgtacaccctgtccagctccgtcacggtgcccagctccacctggcccagcgagaccgtgacctgcaacgtcgcccaccccgcgtccagcacgaaggtggacaagaagatcgtgccgcgggactgcggctgcaagccctgcatctgcaccgtccccgaggtgtccagcgtgttcatcttcccgcccaagcccaaggacgtcctcaccatcaccctgacgcccaaggtgacctgcgtcgtggtggacatctccaaggacgaccccgaggtccagttcagctggttcgtggacgacgtggaggtccacaccgcccagacccagccgcgcgaggagcagttcaactccacgttccggagcgtgtccgagctgcccatcatgcaccaggactggctcaacggcaaggagttcaagtgccgcgtgaacagcgccgccttccccgcccccatcgagaagaccatcagcaagaccaaggggcggccgaaggcgccccaggtctacaccatcccgccgcccaaggagcagatggccaaggacaaggtgtccctgacgtgcatgatcaccgacttcttccccgaggacatcaccgtggagtggcagtggaacggccagcccgccgagaactacaagaacacccagcccatcatggacacggacgggagctacttcgtctactccaagctgaacgtgcagaagtccaactgggaggccggcaacaccttcacgtgcagcgtgctccacgaggggctgcacaaccaccacaccgagaagtccctgagccacagccccggcaag

SEQ ID NO: 12958 - RNA, 1380 nt, synthetic construct; identical to SEQ ID NO: 12957
  misc_feature 1..1380: note = derived and/or modified sequence opt1 from anti-influenza_Chain
  source 1..1380: mol_type = other RNA

SEQ ID NO: 12959 - RNA, 1386 nt, synthetic construct
  misc_feature 1..1386: note = derived and/or modified sequence opt1 from anti-influenza_Chain
  source 1..1386: mol_type = other RNA
atggagtggagctggatcttcctgttcctcctgtccggcaccgccggggtgcacagcgaggtccagctgcagcagtccggccccgagctcgtgaagccgggggccagcgtgaagatgtcctgcaaggcgagcggctacaccttcacctcctacgtcatgcactgggtgaagcagaagcccgggcagggcctggagtggatcggctacatcaacccctacaacgacgggacccgctacaacgagaagttccgggtgaaggccaccctgaccagcgacaagtccagctccacggcctacatggagctcagctccctgaccagcgaggactccgccgtctactactgcgcccgccggggcctgatcaccacccccacgctcgactactgggggcagggcaccaccctgaccgtgagctccgcgaagacgaccccgcccagcgtgtaccccctggcccccgggtccgccgcccagaccaacagcatggtcaccctcggctgcctggtgaagggctacttcccggagcccgtgacggtcacctggaacagcgggtccctgagctccggcgtgcacaccttccccgcggtgctccagagcgacctgtacaccctgtccagctccgtcacggtgcccagctccacctggccgagcgagaccgtgacctgcaacgtcgcccaccccgcctccagcacgaaggtggacaagaagatcgtgccccgcgactgcgggtgcaagccctgcatctgcaccgtcccggaggtgtccagcgtgttcatcttcccgcccaagcccaaggacgtcctcaccatcaccctgacgcccaaggtgacctgcgtcgtggtggacatctccaaggacgaccccgaggtccagttcagctgggtggacgacgtggaggtccacaccgcccagacccagccccgggaggagcagttcaactccacgttccgcagcgtgtccgagctgcccatcatgcaccaggactggctcaacggcaaggagttcaagtgccgggtgaacagcgccgcgttcccggcccccatcgagaagaccatcagcaagaccaagggccgccccaaggcgccccaggtctacaccatcccgccgcccaaggagcagatggccaaggacaaggtgtccctgacgtgcatgatcaccgacttcttccccgaggacatcaccgtggagtggcagtggaacgggcagcccgccgagaactacaagaacacccagcccatcatggacaccgacggcagctacttcgtctactccaagctgaacgtgcagaagtccaactgggaggccgggaacacgttcacgtgcagcgtgctccacgagggcctgcacaaccaccacaccgagaagtccctgagccacagccccgggaag

SEQ ID NO: 12960 - RNA, 1386 nt, synthetic construct
  misc_feature 1..1386: note = derived and/or modified sequence opt1 from anti-influenza_Chain
  source 1..1386: mol_type = other RNA
caggtgcagctggtccagagcggcgccgaggtgaagaagcccggggcctccgtgaaggtcagctgcaagacctccggctacaccttcacggcgtacaccatccactgggtgcgccaggccccggggcagcggctcgagtggatgggctggatcaacgccgggaacggccacaccaagtacagccagcgcttcaagggccgggtgaccatcacgcgcgacacctccgcccggaccacctacatggagctgcgcagcctgacgtccgaggacaccgccctctacttctgcgcgcgggggcccgagacctactactacgacaagaccaactggctgaacagccaccccgacgagtacttccagcactggggccacgggacgcaggtcaccgtgtccagcgcctccaccaagggccccagcgtgttcccgctggccccctccagcaagtccaccagcgggggcacggccgcgctcggctgcctggtcaaggactacttccccgagcccgtgaccgtgtcctggaacagcggggccctgacctccggcgtccacaccttcccggccgtgctccagagcagcgggctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacgtgcccgccctgccccgcccccgagctgctgggcgggccgtccgtgttcctcttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgtccgtcctgaccgtgctccaccaggactggctgaacgggaaggagtacaagtgcaaggtgagcaacaaggcgctgcccgccccgatcgagaagacgatctccaaggccaagggccagccccgggagccccaggtctacaccctgcccccgagccgcgacgagctcaccaagaaccaggtgtccctgacctgcctcgtgaaggggttctaccccagcgacatcgccgtcgagtgggagtccaacggccagcccgagaacaactacaagacgaccccgcccgtgctggacagcgacggcagcttcttcctgtactccaagctcaccgtggacaagagccggtggcagcaggggaacgtcttctcctgcagcgtgatgcacgaggccctgcacaaccactacacccagaagtccctgagcctctcccccggcaag

SEQ ID NO: 12961 - RNA, 1386 nt, synthetic construct; identical to SEQ ID NO: 12960
  misc_feature 1..1386: note = derived and/or modified sequence opt1 from anti-influenza_Chain
  source 1..1386: mol_type = other RNA

SEQ ID NO: 12962 - RNA, 1386 nt, synthetic construct; identical to SEQ ID NO: 12959
  misc_feature 1..1386: note = derived and/or modified sequence opt1 from anti-influenza_Chain
  source 1..1386: mol_type = other RNA

SEQ ID NO: 12963 - RNA, 1398 nt, synthetic construct
  misc_feature 1..1398: note = derived and/or modified sequence opt1 from anti-influenza_Chain
  source 1..1398: mol_type = other RNA
atgctgcccagcaccgtgcagaccctcacgctgctgctcacctccggcggggtcctgctgagcctctacgtgtccgccagcctgtcctacctgctctacagcgacgtgctgctgaagttctccagcaccaagaccacggccccgaccatgtccctcgagtgcaccaacgcgagcaacgcccagaccgtcaaccactccgccacgaaggagatgaccttcccgccgcccgagcccgagtggacctacccccgcctgagctgccagggctccaccttccagaaggccctgctcatcagcccccaccggttcggggagatcaagggcaactccgcgcccctgatcatccgcgagcccttcgtggcctgcgggcccaaggagtgccggcacttcgccctgacgcactacgccgcccagcccggcggctactacaacgggacccgcaaggaccggaacaagctccgccacctggtgagcgtcaagctgggcaagatccccaccgtggagaactccatcttccacatggcggcctggagcgggtccgcctgccacgacggccgggagtggacctacatcggggtggacggcccggacaacgacgccctcgtcaagatcaagtacggcgaggcctacacggacacctaccacagctacgcgcacaacatcctgcgcacccaggagagcgcctgcaactgcatcgggggcgactgctacctgatgatcaccgacgggtccgccagcggcatctccaagtgccggttcctcaagatccgcgagggccggatcatcaaggagatcctgcccacggggcgcgtggagcacaccgaggagtgcacgtgcggcttcgccagcaacaagaccatcgagtgcgcctgccgggacaactcctacaccgcgaagcgccccttcgtgaagctgaacgtcgagaccgacaccgccgagatccggctcatgtgcaccaagacgtacctggacacgccccgcccggacgacgggagcatcgccggcccctgcgagtccaacggggacaagtggctgggcggcatcaagggcgggttcgtgcaccagcggatggccagcaagatcgggcgctggtactcccggaccatgagcaagaccaaccgcatgggcatggagctctacgtgaagtacgacggggacccctggaccgactccgacgccctgaccctgagcggcgtcatggtgtccatcgaggagcccggctggtacagcttcgggttcgagatcaaggacaagaagtgcgacgtgccgtgcatcggcatcgagatggtccacgacgggggcaaggacacctggcactccgcggccaccgccatctactgcctcatggggagcggccagctgctgtgggacacggtgaccggcgtggacatggccctc

SEQ ID NO: 12964 - RNA, 1398 nt, synthetic construct; identical to SEQ ID NO: 12963
  misc_feature 1..1398: note = derived and/or modified sequence opt1 from anti-influenza_Chain
  source 1..1398: mol_type = other RNA

SEQ ID NO: 12965 - RNA, 1407 nt, synthetic construct
  misc_feature 1..1407: note = derived and/or modified sequence opt1 from anti-influenza_Chain
  source 1..1407: mol_type = other RNA
atggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgctgaacaactacgccatcagctgggtgcggcaggccccggggcagggcctggagtggatgggcgggatctcccccatcttcggcaccctcaactacgcggagcgcttccaggggcgggtgaccatcaccgccgacgtcttcacgaacaccgtgtacatggagctgagctccctgcgcagcgaggacaccgccgtgtacttctgcgcccggggctgcgggtacaactgctactacttcgacggctggggccaggggaccctcgtcacggtgtccagcgcgtccaccaagggccccagcgtgttccccctggccccgtccagcaagtccaccagcgggggcaccgccgccctgggctgcctcgtcaaggactacttccccgagcccgtgacggtgtcctggaacagcggggccctgaccagcggcgtccacaccttccccgcggtgctgcagtccagcgggctctactccctgagctccgtggtcaccgtgccgagctccagcctgggcacgcagacctacatctgcaacgtgaaccacaagccctccaacaccaaggtcgacaagaaggtggagcccaagagctgcgacaagacccacacgtgcccgccctgccccgcccccgagctcctcgggggcccctccgtcttcctgttcccgcccaagcccaaggacaccctgatgatcagccgcacccccgaggtgacctgcgtggtcgtggacgtgtcccacgaggacccggaggtcaagttcaactggtacgtggacggcgtggaggtccacaacgccaagacgaagccccgggaggagcagtacaacagcacctaccgcgtggtgtccgtcctgaccgtgctgcaccaggactggctcaacgggaaggagtacaagtgcaaggtgagcaacaaggccctgcccgcccccatcgagaagaccatctccaaggcgaagggccagccgcgggagccccaggtctacacgctgccgcccagccgcgacgagctcaccaagaaccaggtgtccctgacctgcctggtgaaggggttctaccccagcgacatcgccgtcgagtgggagagcaacggccagcccgagaacaactacaagaccacgcccccggtgctcgactccgacgggagcttcttcctgtactccaagctgaccgtggacaagagccggtggcagcagggcaacgtcttctcctgcagcgtgatgcacgagggcctccacaaccactacacccagaagtccctgagcctgtcccccgggaag

SEQ ID NO: 12966 - RNA, 1407 nt, synthetic construct; identical to SEQ ID NO: 12965
  misc_feature 1..1407: note = derived and/or modified sequence opt1 from anti-influenza_Chain
  source 1..1407: mol_type = other RNA

SEQ ID NO: 12967 - RNA, 1407 nt, synthetic construct; identical to SEQ ID NO: 12965
  misc_feature 1..1407: note = derived and/or modified sequence opt1 from anti-influenza_Chain
  source 1..1407: mol_type = other RNA

SEQ ID NO: 12968 - RNA, 1413 nt, synthetic construct
  misc_feature 1..1413: note = derived and/or modified sequence opt1 from anti-influenza_Chain
  source 1..1413: mol_type = other RNA
gacggcgtgaagcccctgatcctccgcgactgcagcgtcgccgggtggctgctgggcaacccgatgtgcgacgagttcatcaacgtgcccgagtggtcctacatcgtggagaaggccaaccccgcgaacgacctctgctaccccgggaacttcaacgactacgaggagctgaagcacctcctcagccggatcaaccacttcgagaagatccagatcatcccgaagtccagctggtccgaccacgaggccagctccggcgtcagctccgcctgcccctaccaggggacccccagcttcttccgcaacgtggtgtggctgatcaagaagaacaacacctaccccacgatcaagcggtcctacaacaacaccaaccaggaggacctgctcatcctgtggggcatccaccacagcaacgacgccgccgagcagaccaagctgtaccagaacccgaccacgtacatctccgtcggcaccagcaccctcaaccagcgcctggtgcccaagatcgcgacccggtccaaggtgaacgggcagaacggccgcatggacttcttctggacgatcctgaagcccaacgacgccatcaacttcgagagcaacgggaacttcatcgcccccgagtacgcctacaagatcgtcaagaagggctacatcccggaggcgccccgggacgggcaggcctacgtgcgcaaggacggcgagtgggtgctcctgtccaccttcctgcggagcgacaagacccacacgtgcccgccctgcccggcccccgagctcctgggcgggccctccgtcttcctgttcccgcccaagcccaaggacaccctcatgatcagccgcacccccgaggtgacctgcgtggtcgtggacgtgagccacgaggaccccgaggtcaagttcaactggtacgtggacggcgtggaggtccacaacgccaagaccaagccgcgggaggagcagtacaactccacgtaccgcgtggtgagcgtcctgaccgtgctgcaccaggactggctcaacgggaaggagtacaagtgcaaggtctccaacaaggccctgcccgcgcccatcgagaagaccatcagcaaggccaagggccagccccgggagccccaggtgtacaccctgccgccctcccgcgaggagatgacgaagaaccaggtgagcctgacctgcctggtcaagggcttctacccctccgacatcgccgtggagtgggagagcaacgggcagcccgagaacaactacaagaccaccccgcccgtgctggactccgacggcagcttcttcctctactccaagctgacggtcgacaagagccggtggcagcaggggaacgtgttctcctgcagcgtgatgcacgaggccctgcacaaccactacacccagaagtccctcagcctgtcccccggcaag

SEQ ID NO: 12969 - RNA, 1413 nt, synthetic construct; identical to SEQ ID NO: 12968
  misc_feature 1..1413: note = derived and/or modified sequence opt1 from anti-influenza_Chain
  source 1..1413: mol_type = other RNA

SEQ ID NO: 12970 - RNA, 1416 nt, synthetic construct
  misc_feature 1..1416: note = derived and/or modified sequence opt1 from anti-influenza_Chain
  source 1..1416: mol_type = other RNA
atggactggacctggcgcttcctgttcgtggtcgccgccgcgaccggcgtgcagtgccaggtgcagctcgtccagagcggggccgaggtgaagatgcccggctccagcgtgaaggtctcctgcaagacgagcggggtgttcttctccagccacgccatctcctgggtgcggcaggcccccggccaggggctggagtggatgggcggcatcagccccatgttcgggaccacccactacgcccagaagttccagggccgcgtcaccatcacggcggaccagtccaccaccaccgcctacatggagctgacgagcctcacctccgaggacaccgccgtgtactactgcgcccgggacggggcgggcagctactaccccctgaactggttcgacccctgggggcagggcaccctggtgacggtctccagcgcctccaccaagggcccgagcgtgttccccctcgccccctccagcaagtccaccagcgggggcaccgccgccctggggtgcctggtgaaggactacttccccgagccggtcacggtgagctggaactccggcgcgctcaccagcggcgtgcacaccttccccgccgtcctgcagtccagcgggctgtactccctcagctccgtggtgaccgtccccagctccagcctgggcacgcagacctacatctgcaacgtgaaccacaagccctccaacaccaaggtggacaagcgcgtcgagcccaagagctgcgacaagacccacacgtgcccgccctgccccgccccggagctgctcgggggcccctccgtgttcctgttcccgcccaagcccaaggacaccctgatgatcagccggacccccgaggtgacctgcgtcgtggtcgacgtgtcccacgaggaccccgaggtgaagttcaactggtacgtcgacggggtggaggtgcacaacgccaagacgaagccccgcgaggagcagtacaacagcacctaccgggtcgtgtccgtgctcaccgtcctgcaccaggactggctgaacggcaaggagtacaagtgcaaggtgagcaacaaggccctcccggcgcccatcgagaagaccatctccaaggccaagggccagccccgcgagccccaggtgtacacgctgccgcccagccgggacgagctgaccaagaaccaggtcagcctgacctgcctcgtgaaggggttctacccctccgacatcgccgtggagtgggagagcaacggccagccggagaacaactacaagaccacgccgcccgtcctggactccgacgggagcttcttcctctactccaagctgaccgtggacaagagccgctggcagcagggcaacgtgttctcctgcagcgtcatgcacgaggggctgcacaaccactacacccagaagtccctcagcctgtcccccggcaag

SEQ ID NO: 12971 - RNA, 1416 nt, synthetic construct; identical to SEQ ID NO: 12970
  misc_feature 1..1416: note = derived and/or modified sequence opt1 from anti-influenza_Chain
  source 1..1416: mol_type = other RNA

SEQ ID NO: 12972 - RNA, 1416 nt, synthetic construct; identical to SEQ ID NO: 12970
  misc_feature 1..1416: note = derived and/or modified sequence opt1 from anti-influenza_Chain
  source 1..1416: mol_type = other RNA

SEQ ID NO: 12973 - RNA, 1419 nt, synthetic construct
  misc_feature 1..1419: note = derived and/or modified sequence opt1 from anti-influenza_Chain
  source 1..1419: mol_type = other RNA
atgaccgagagcgccatgacctcccgcgccggccgggggcgcggcgcggacctggtggccgccgtcgtgcaggggcacgccgccgcgagcgacgccgccggcgacctctccttccccgacgggttcatctggggcgccgcgacggccgcctaccagatcgagggcgcctggcgggaggacgggcgcggcctgtgggacgtgttcagccacaccccggggaaggtcgcctccggccacaccggggacatcgcgtgcgaccactaccaccggtacgccgacgacgtgcgcctgatggccggcctcggcgaccgggtgtaccgcttcagcgtcgcctggccccggatcgtgcccgacgggtccggccccgtgaacccggccgggctggacttctacgaccgcctggtcgacgagctcctgggccacggcatcaccccctaccccacgctgtaccactgggacctcccccagaccctggaggaccgcgggggctgggcggcccgggacaccgcctaccggttcgccgagtacgccctggcggtgcaccgccggctcggggaccgcgtgcggtgctggatcaccctgaacgagccgtgggtcgccgccttcctggccacgcaccgcggcgcccccggggcggccgacgtgccccggttccgcgccgtgcaccacctcctgctgggccacggcctcgggctgcggctgcgcagcgccggcgcggggcagctcggcctgaccctgtccctcagccccgtcatcgaggcccgcccgggggtgcggggcggcgggcgccgggtggacgccctggccaaccgccagttcctggaccccgccctccggggccgctaccccgaggaggtcctgaagatcatggcggggcacgcccggctgggccaccccgggcgcgacctcgagaccatccaccagccggtggacctgctgggcgtgaactactactcccacgtccggctcgccgccgagggcgagcccgccaaccgcctgcccgggagcgagggcatccggttcgagcgccccaccgcggtgacggcctggccgggggaccggcccgacggcctgcgcaccctcctgctgcggctctcccgcgactaccccggcgtggggctgatcatcaccgagaacggcgccgccttcgacgaccgggccgacggggaccgcgtccacgaccccgagcggatccgctacctgaccgcgacgctccgcgccgtgcacgacgccatcatggccggcgcggacctgcgggggtacttcgtctggagcgtgctggacaacttcgagtgggcctacggctaccacaagcgcggcatcgtgtacgtcgactacaccaccatgcggcgcatcccgcgggagtccgccctctggtaccgcgacgtggtgcggcgcaacgggctgcggaacggcgag

SEQ ID NO: 12974 - RNA, 1419 nt, synthetic construct; identical to SEQ ID NO: 12973
  misc_feature 1..1419: note = derived and/or modified sequence opt1 from anti-influenza_Chain
  source 1..1419: mol_type = other RNA

SEQ ID NO: 12975 - RNA, 1422 nt, synthetic construct
  misc_feature 1..1422: note = derived and/or modified sequence opt1 from anti-influenza_Chain
  source 1..1422: mol_type = other RNA
ctgagccgcatcaaccacttcgagaagatccagatcatccccaagtccagctggtccgaccacgaggccagctccggcgtgagctccgcctgcccgtaccaggggacccccagcttcttccggaacgtcgtgtggctcatcaagaagaacaacacctaccccacgatcaagcgctcctacaacaacaccaaccaggaggacctgctgatcctctggggcatccaccacagcaacgacgcggccgagcagaccaagctgtaccagaaccccaccacgtacatctccgtggggaccagcaccctgaaccagcggctcgtcccgaagatcgccacccgctccaaggtgaacggccagaacgggcggatggacttcttctggacgatcctgaagcccaacgacgccatcaacttcgagagcaacggcaacttcatcgcccccgagtacgcgtacaagatcgtgaagaagggcgactccgccatcgtcaagagcgaggtggagtacgggaactgcaacaccaagtgccagacccccatcggcgccatcaactccagcatgccgttccacaacatccaccccctgaccatcggggagtgccccaagtacgtgaagtccaacaagctcgtcctggccacgggcctgcgcaacagccccctcgggtacatcccggaggcgccccgggacggccaggcctacgtgcgcaaggacggcgagtgggtgctgctgagcaccttcctccggtccgacaagacccacacgtgcccgccctgcccggcccccgagctgctcgggggccccagcgtcttcctgttcccgcccaagcccaaggacaccctgatgatctcccgcacccccgaggtgacctgcgtggtcgtggacgtgagccacgaggaccccgaggtcaagttcaactggtacgtggacggggtggaggtccacaacgccaagaccaagccgcgggaggagcagtacaactccacgtaccgcgtggtgagcgtcctgaccgtgctccaccaggactggctgaacggcaaggagtacaagtgcaaggtctccaacaaggccctgcccgcgcccatcgagaagaccatcagcaaggccaagggccagccccgggagccccaggtgtacaccctcccgccctcccgcgaggagatgacgaagaaccaggtgagcctgacctgcctggtcaaggggttctacccctccgacatcgccgtggagtgggagagcaacggccagcccgagaacaactacaagaccaccccgcccgtgctcgactccgacgggagcttcttcctgtactccaagctgacggtcgacaagagccggtggcagcagggcaacgtgttctcctgcagcgtgatgcacgaggccctccacaaccactacacccagaagtccctgagcctgagccccgggaag

SEQ ID NO: 12976 - RNA, 1422 nt, synthetic construct; identical to SEQ ID NO: 12975
  misc_feature 1..1422: note = derived and/or modified sequence opt1 from anti-influenza_Chain
  source 1..1422: mol_type = other RNA

SEQ ID NO: 12977 - RNA, 1428 nt, synthetic construct
  misc_feature 1..1428: note = derived and/or modified sequence opt1 from anti-influenza_Chain
  source 1..1428: mol_type = other RNA
atggagttcggcctgagctgggtgttcctcgtcgccctgctgcgcggggtgcagtgccaggtgcagctcgtcgagtccggcgggggcgtggtgcagcccgggcggagcctgcgcctgtcctgcgccgcgagcggcttcaccttctcccggttcggcatccactgggtccgccaggccccggggaagggcctcgagtggatggccgtgatctggtacgacgggagcaacaagttctacgccgactccgtgaagggccggttcaccatcagccgcgacaactccaagaacacggtctacctgcagatgaacagcctgcgggccgaggacaccgcggtgtactactgcgccaaggactcccgcgggtactgcagctccatcatctgcttcgagggcggcctcgacaactgggggcagggcaccctggtgaccgtcagctccgccagcacgaaggggccctccgtgttccccctggcccccagctccaagagcaccagcggcggcaccgcggccctcgggtgcctggtgaaggactacttcccggagcccgtcaccgtgtcctggaacagcggcgccctgacgtccggggtgcacaccttccccgccgtcctccagagctccggcctgtacagcctgtccagcgtggtgaccgtcccctccagctccctcgggacccagacgtacatctgcaacgtgaaccacaagccgagcaacaccaaggtggacaagcgggtcgagcccaagtcctgcgacaagacccacacgtgcccgccctgcccggcccccgagctgctgggcggccccagcgtgttcctcttcccgcccaagcccaaggacaccctgatgatctcccgcacccccgaggtgacctgcgtcgtggtcgacgtgagccacgaggaccccgaggtgaagttcaactggtacgtcgacggggtggaggtgcacaacgcgaagaccaagccgcgggaggagcagtacaactccacgtaccgcgtcgtgagcgtgctgaccgtcctccaccaggactggctgaacggcaaggagtacaagtgcaaggtgtccaacaaggccctgcccgcccccatcgagaagaccatcagcaaggccaaggggcagccccgggagccccaggtgtacaccctcccgcccagccgcgacgagctgacgaagaaccaggtctccctgacctgcctcgtgaagggcttctaccccagcgacatcgccgtggagtgggagtccaacgggcagcccgagaacaactacaagaccaccccgcccgtcctggacagcgacggctccttcttcctgtacagcaagctcacggtggacaagtcccggtggcagcagggcaacgtgttcagctgctccgtcatgcacgaggggctgcacaaccactacacccagaagtccctgagcctcagccccggcaag

SEQ ID NO: 12978 - RNA, 1428 nt, synthetic construct; identical to SEQ ID NO: 12977
  misc_feature 1..1428: note = derived and/or modified sequence opt1 from anti-influenza_Chain
  source 1..1428: mol_type = other RNA

SEQ ID NO: 12979 - RNA, 1428 nt, synthetic construct; identical to SEQ ID NO: 12977
  misc_feature 1..1428: note = derived and/or modified sequence opt1 from anti-influenza_Chain
  source 1..1428: mol_type = other RNA

SEQ ID NO: 12980 - RNA, 1440 nt, synthetic construct
  misc_feature 1..1440: note = derived and/or modified sequence opt1 from anti-influenza_Chain
  source 1..1440: mol_type = other RNA
atgcccagcgtgaagatcggcatcatcggggccggctccgccgtgttcagcctgcgcctcgtgtccgacctgtgcaagaccccggggctgagcggctccaccgtgacgctcatggacatcgacgaggagcggctggacgcgatcctgaccatcgccaagaagtacgtcgaggaggtgggggccgacctcaagttcgagaagaccatgaacctggacgacgtgatcatcgacgccgacttcgtcatcaacaccgccatggtgggcggccacacgtacctggagaaggtgcgccagatcggggagaagtacggctactaccgggggatcgacgcgcaggagttcaacatggtcagcgactactacaccttctccaactacaaccagctcaagtacttcgtggacatcgcccgcaagatcgagaagctgagccccaaggcctggtacctgcaggccgcgaaccccatcttcgagggcaccaccctcgtgacgcggaccgtccccatcaaggccgtggggttctgccacggccactacggcgtgatggagatcgtcgagaagctggggctggaggaggagaaggtggactggcaggtcgccggcgtgaaccacgggatctggctcaaccgcttccggtacaacggcggcaacgcctacccgctgctggacaagtggatcgaggagaagtccaaggactggaagcccgagaaccccttcaacgaccagctcagccccgccgcgatcgacatgtaccgcttctacggggtgatgccgatcggcgacaccgtgcggaactccagctggcgctaccaccgggacctggagaccaagaagaagtggtacggggagccctggggcggggccgactccgagatcggctggaagtggtaccaggacacgctgggcaaggtcaccgagatcaccaagaaggtggccaagttcatcaaggagaaccccagcgtgcgcctctccgacctggggagcgtcctgggcaaggacctctccgagaagcagttcgtgctggaggtcgagaagatcctggaccccgagcgcaagagcggggagcagcacatcccgttcatcgacgccctcctgaacgacaacaaggcccggttcgtggtgaacatccccaacaagggcatcatccacgggatcgacgacgacgtcgtggtggaggtccccgcgctggtggacaagaacggcatccaccccgagaagatcgagccgcccctccccgaccgggtggtcaagtactacctgcgcccccggatcatgcgcatggagatggccctggaggccttcctcaccggcgacatccggatcatcaaggagctgctgtaccgcgacccgcggacgaagtccgacgagcaggtcgagaaggtgatcgaggagatcctcgccctgcccgagaacgaggagatgcgcaagcactacctgaagcgc

SEQ ID NO: 12981 - RNA, 1440 nt, synthetic construct; identical to SEQ ID NO: 12980
  misc_feature 1..1440: note = derived and/or modified sequence opt1 from anti-influenza_Chain
  source 1..1440: mol_type = other RNA

SEQ ID NO: 12982 - RNA, 1443 nt, synthetic construct
  misc_feature 1..1443: note = derived and/or modified sequence opt1 from anti-influenza_Chain
  source 1..1443: mol_type = other RNA
atgaagttccccaaggacttcatgatcggctacagctccagcccgttccagttcgaggccgggatccccggctccgaggaccccaacagcgactggtgggtgtgggtccacgaccccgagaacaccgccgcggggctggtgtccggcgacttcccggagaacgggcccggctactggaacctcaaccagaacgaccacgacctggccgagaagctgggcgtgaacaccatccgcgtcggggtggagtggagccggatcttccccaagcccacgttcaacgtgaaggtcccggtggagcgcgacgagaacggctccatcgtgcacgtcgacgtggacgacaaggccgtggagcggctcgacgagctggccaacaaggaggccgtcaaccactacgtggagatgtacaaggactgggtggagcgcgggcggaagctgatcctcaacctgtaccactggcccctgcccctctggctgcacaaccccatcatggtccgccggatgggcccggaccgcgcgcccagcgggtggctgaacgaggagtccgtggtggagttcgccaagtacgccgcctacatcgcgtggaagatgggcgagctccccgtcatgtggagcaccatgaacgagcccaacgtggtgtacgagcagggctacatgttcgtcaagggcgggttcccgcccgggtacctgtccctggaggccgccgacaaggcccggcgcaacatgatccaggcccacgcgcgggcctacgacaacatcaagcgcttcagcaagaagcccgtgggcctcatctacgccttccagtggttcgagctgctggagggccccgccgaggtgttcgacaagttcaagtccagcaagctctactacttcaccgacatcgtctccaaggggagctccatcatcaacgtggagtaccggcgcgacctggccaaccggctggactggctcggcgtcaactactacagccgcctggtgtacaagatcgtggacgacaagccgatcatcctgcacgggtacggcttcctctgcacccccgggggcatctcccccgcggagaacccctgcagcgacttcggctgggaggtctacccggaggggctgtacctgctcctgaaggagctgtacaaccggtacggcgtggacctcatcgtgacggagaacggggtcagcgactcccgcgacgccctgcggcccgcctacctggtgagccacgtgtactccgtctggaaggccgccaacgagggcatccccgtgaaggggtacctccactggagcctgaccgacaactacgagtgggcgcagggcttccgccagaagttcggcctggtgatggtcgacttcaagaccaagaagcggtacctccgcccctccgccctggtgttccgcgagatcgccacccacaacgggatcccggacgagctgcagcacctcacgctgatccag

SEQ ID NO: 12983 - RNA, 1443 nt, synthetic construct; identical to SEQ ID NO: 12982
  misc_feature 1..1443: note = derived and/or modified sequence opt1 from anti-influenza_Chain
  source 1..1443: mol_type = other RNA

SEQ ID NO: 12984 - RNA, 1464 nt, synthetic construct
  misc_feature 1..1464: note = derived and/or modified sequence opt1 from anti-influenza_Chain
  source 1..1464: mol_type = other RNA
cacgcccaggacatcctggagaagacccacaacggcaagctctgcgacctggacggggtgaagcccctgatcctccgcgactgcagcgtcgccggctggctgctggggaacccgatgtgcgacgagttcatcaacgtgcccgagtggtcctacatcgtggagaaggcgaaccccgccaacgacctctgctaccccggcaacttcaacgactacgaggagctgaagcacctcctcagccggatcaaccacttcgagaagatccagatcatcccgaagtccagctggtccgaccacgaggccagctccggggtcagctccgcctgcccctaccagggcacccccagcttcttccgcaacgtggtgtggctgatcaagaagaacaacacgtaccccaccatcaagcggtcctacaacaacaccaaccaggaggacctgctcatcctgtggggcatccaccacagcaacgacgccgcggagcagaccaagctgtaccagaacccgacgacctacatctccgtcgggaccagcaccctcaaccagcgcctggtgcccaagatcgccacgcggtccaaggtgaacggccagaacgggcgcatggacttcttctggaccatcctgaagcccaacgacgccatcaacttcgagagcaacggcaacttcatcgcccccgagtacgcgtacaagatcgtcaagaaggggtacatcccggaggcgccccgggacggccaggcctacgtgcgcaaggacggcgagtgggtgctcctgtccaccttcctgcggagcgacaagacccacacgtgcccgccctgcccggcccccgagctcctcgggggcccctccgtcttcctgttcccgcccaagcccaaggacaccctgatgatcagccgcacccccgaggtgacctgcgtggtcgtggacgtgagccacgaggaccccgaggtcaagttcaactggtacgtggacggggtggaggtccacaacgccaagacgaagccgcgggaggagcagtacaactccacctaccgcgtggtgagcgtcctgaccgtgctgcaccaggactggctcaacggcaaggagtacaagtgcaaggtctccaacaaggccctgcccgcccccatcgagaagaccatcagcaaggccaagggccagccccgggagccccaggtgtacacgctgccgccctcccgcgaggagatgaccaagaaccaggtgagcctgacctgcctggtcaaggggttctacccctccgacatcgccgtggagtgggagagcaacggccagcccgagaacaactacaagaccacgccgcccgtgctggactccgacgggagcttcttcctctactccaagctgaccgtcgacaagagccggtggcagcagggcaacgtgttctcctgcagcgtgatgcacgaggccctgcacaaccactacacccagaagtccctcagcctgtcccccgggaag

SEQ ID NO: 12985 - RNA, 1464 nt, synthetic construct; identical to SEQ ID NO: 12984
  misc_feature 1..1464: note = derived and/or modified sequence opt1 from anti-influenza_Chain
  source 1..1464: mol_type = other RNA

SEQ ID NO: 12986 - RNA, 1473 nt, synthetic construct
  misc_feature 1..1473: note = derived and/or modified sequence opt1 from anti-influenza_Chain
  source 1..1473: mol_type = other RNA
atgctgagcttccccaagggcttcaagttcgggtggtcccagagcggcttccagtccgagatggggacccccggcagcgaggaccccaactccgactggcacgtgtgggtccacgaccgcgagaacatcgtgagccaggtggtctccggggacctccccgagaacggccccggctactgggggaactacaagcggttccacgacgaggccgagaagatcggcctgaacgccgtgcgcatcaacgtggagtggagccggatcttcccgcgccccctgcccaagcccgagatgcagaccgggacggacaaggagaactccccggtcatcagcgtggacctcaacgagtccaagctgcgggagatggacaactacgcgaaccacgaggccctgagccactaccgccagatcctcgaggacctgcggaaccgcggcttccacatcgtgctgaacatgtaccactggaccctccccatctggctgcacgaccccatccgggtccgccgcggggacttcaccggccccaccggctggctgaactcccggacggtgtacgagttcgcccggttcagcgcctacgtggcctggaagctcgacgacctggcgtccgagtacgccaccatgaacgagccgaacgtcgtgtggggcgccgggtacgccttcccccgcgcggggttcccgcccaactacctgagcttccggctctccgagatcgccaagtggaacatcatccaggcccacgcccgcgcctacgacgcgatcaagagcgtgtccaagaagtccgtcggcatcatctacgccaacaccagctactaccccctgcggccccaggacaacgaggccgtggagatcgccgagcgcctgaaccggtggagcttcttcgacagcatcatcaagggcgagatcacctccgaggggcagaacgtgcgcgaggacctccggaaccgcctggactggatcggcgtcaactactacacgcgcaccgtggtgaccaaggccgagagcgggtacctgaccctccccggctacggggaccggtgcgagcgcaactccctgagcctggcgaacctccccacgtccgacttcggctgggagttcttcccggagggcctgtacgacgtcctgctcaagtactggaaccggtacgggctgcccctgtacgtgatggagaacggcatcgccgacgacgccgactaccagcgcccctactacctcgtgagccacatctaccaggtccaccgggccctgaacgagggggtggacgtccgcggctacctgcactggtccctcgccgacaactacgagtggagctccgggttcagcatgcggttcggcctgctgaaggtggactacctcaccaagcgcctgtactggcggccctccgcgctggtgtaccgcgagatcacccggagcaacggcatcccggaggagctcgagcacctgaaccgcgtcccgcccatcaagcccctgcggcac

SEQ ID NO: 12987 - RNA, 1473 nt, synthetic construct; identical to SEQ ID NO: 12986
  misc_feature 1..1473: note = derived and/or modified sequence opt1 from anti-influenza_Chain
  source 1..1473: mol_type = other RNA

SEQ ID NO: 12988 - RNA, 1494 nt, synthetic construct
  misc_feature 1..1494: note = derived and/or modified sequence opt1 from anti-influenza_Chain
  source 1..1494: mol_type = other RNA
atggccagccagggcaccaagcgctcctacgagcagatggagaccgacggggagcggcagaacgccacggagatccgcgcgagcgtgggcaagatgatcgggggcatcgggcggttctacatccagatgtgcaccgagctgaagctctccgactacgagggccgcctgatccagaacagcctgaccatcgagcggatggtcctctccgccttcgacgagcgccggaacaagtacctggaggagcaccccagcgccggcaaggacccgaagaagaccgggggccccatctaccgccgggtgaacgggaagtggatgcgcgagctgatcctctacgacaaggaggagatccggcgcatctggcggcaggccaacaacggcgacgacgccacggcggggctgacccacatgatgatctggcactccaacctgaacgacgccacctaccagcgcacccgggccctcgtgcgcacgggcatggacccccggatgtgcagcctgatgcagggctccaccctgccccgccggagcggggccgcgggcgccgccgtcaagggggtgggcaccatggtgatggagctcgtccgcatgatcaagcggggcatcaacgaccgcaacttctggcgcggggagaacggccggaagacccgcatcgcctacgagcggatgtgcaacatcctgaaggggaagttccagacggccgcgcagaaggccatgatggaccaggtgcgcgagtcccgggacccgggcaacgccgagttcgaggacctgaccttcctcgcccgcagcgccctgatcctgcgggggtccgtggcgcacaagagctgcctccccgcctgcgtctacggccccgccgtggcctccggctacgacttcgagcgcgaggggtacagcctggtgggcatcgaccccttccggctgctccagaactcccaggtctacagcctgatccgcccgaacgagaaccccgcccacaagtcccagctggtgtggatggcgtgccacagcgccgccttcgaggacctccgggtgctgagcttcatcaaggggaccaaggtcgtgccccgcggcaagctgtccacccgcggggtgcagatcgccagcaacgagaacatggagacgatggagtccagcaccctcgagctgcggtcccggtactgggccatccgcacccggagcggcggcaacaccaaccagcagcgcgcgtccgccgggcagatcagcatccagcccacgttctccgtccagcggaacctgccgttcgaccgcaccaccgtgatggccgccttcaccggcaacacggaggggcgcaccagcgacatgcggaccgagatcatccgcatgatggagtccgcgcggcccgaggacgtgagcttccagggccgcggggtcttcgagctctccgacgagaaggccgccagccccatcgtgccctccttcgacatgagcaacgagggctcctacttcttcggcgacaacgccgaggagtacgacaac

SEQ ID NO: 12989 - RNA, 1494 nt, synthetic construct
  misc_feature 1..1494: note = derived and/or modified sequence opt1 from anti-influenza_Chain
  source 1..1494: mol_type = other RNA
atggccagccagggcaccaagcggtcctacgagcagatggagaccgacggggagcggcagaacgccacggagatccgcgcgagcgtgggcaagatgatcgacgggatcggccggttctacatccagatgtgcaccgagctgaagctctccgactacgaggggcgcctgatccagaacagcctgaccatcgagcggatggtcctctccgccttcgacgagcgccggaacaagtacctggaggagcaccccagcgccggcaaggacccgaagaagaccggcgggcccatctacaagcgcgtggacggcaagtggatgcgggagctggtgctctacgacaaggaggagatccgccggatctggcgccaggccaacaacggggacgacgccacggcgggcctgacccacatgatgatctggcactccaacctgaacgacaccacctaccagcggacgcgcgccctcgtccggaccgggatggacccccgcatgtgcagcctgatgcagggctccaccctgccccggcgcagcggcgccgccggggcggccgtgaagggcgtggggaccatggtcatggagctcatccggatgatcaagcgcggcatcaacgaccggaacttctggcgcggcgagaacgggcgcaagacgcggtccgcctacgagcgcatgtgcaacatcctgaagggcaagttccagaccgccgcccagcgggcgatgatggaccaggtgcgcgagagccggaacccggggaacgccgagatcgaggacctgatcttcctcgcccgctccgccctgatcctgcggggcagcgtggcccacaagtcctgcctccccgcgtgcgtctacgggcccgccatcgccagcggctacaacttcgagaaggagggctactccctggtggggatcgaccccttcaagctgctccagaacagccaggtgtactccctgatccgcccgaacgagaaccccgcccacaagagccagctggtctggatggcctgcaacagcgcggccttcgaggacctccgggtgctgtccttcatccgcggcaccaaggtgagcccccgggggaagctgtccacccgcggcgtccagatcgccagcaacgagaacatggacacgatggagtccagcaccctcgagctgcggtcccgctactgggccatccggacccgcagcgggggcaacaccaaccagcagcgggcctccgcgggccagatcagcgtgcagcccgccttctccgtgcagcgcaacctgccgttcgacaagcccacgatcatggccgccttcaccgggaacaccgagggccggaccagcgacatgcgcgcggagatcatccgcatgatggagggggccaagcccgaggagatgtccttccagggccgcggggtcttcgagctcagcgacgagaaggccacgaaccccatcgtgccgtccttcgacatgagcaacgagggctcctacttcttcggcgacaacgccgaggagtacgacaac

SEQ ID NO: 12990 - RNA, 1494 nt, synthetic construct
  misc_feature 1..1494: note = derived and/or modified sequence opt1 from anti-influenza_Chain
  source 1..1494: mol_type = other RNA
atggccagccagggcaccaagcgctcctacgagcagatggagaccgggggcgagcggcagaacgccacggagatccgcgcgagcgtggggcggatggtcggcgggatcggccgcttctacgtgcagatgtgcaccgagctgaagctctccgaccaggagggccggctgatccagaacagcatcaccatcgagcgcatggtgctgtccgccttcgacgagcggcgcaaccggtacctcgaggagcaccccagcgccgggaaggacccgaagaagaccggcgggcccatctaccgccggcgcgacggcaagtgggtccgggagctgatcctgtacgacaaggaggagatccgccggatctggcgccaggccaacaacggggaggacgccacggcgggcctcacccacatgatgatctggcactccaacctgaacgacgccacctaccagcggacccgcgccctggtgcggacgggcatggacccccgcatgtgcagcctcatgcaggggtccaccctgccccggcgcagcggcgccgcgggggccgccatcaagggcgtgggcaccatggtcatggagctgatccgcatgatcaagcgggggatcaacgaccgcaacttctggcggggcgacaacgggcgccggacccgcatcgcctacgagcggatgtgcaacatcctcaagggcaagttccagacggccgcgcagcgcgccatgatggaccaggtgcgggagtcccgcaacccggggaacgccgagatcgaggacctgatcttcctggcccggagcgccctcatcctgcgcggctccgtggcgcacaagagctgcctgcccgcctgcgtctacggcctcgccgtggcctccgggtacgacttcgagcgggagggctacagcctggtggggatcgaccccttccgcctgctccagaactcccaggtcttcagcctgatccggcccaacgagaacccggcccacaagtcccagctggtgtggatggcgtgccacagcgccgccttcgaggacctccgcgtgagctccttcatccggggcacccgcgtcatcccccgggggcagctgagcacccgcggcgtgcagatcgcctccaacgagaacgtggaggccatggacagctccaccctggagctccgcagccggtactgggcgatccgcacgcggtccggcgggaacaccaaccagcagcgcgccagcgccggccagatctccgtccagcccaccttcagcgtgcagcggaacctgcccttcgagcgcccgaccatcatggccgcgttcaaggggaacacggagggccggacctccgacatgcgcaccgagatcatccggatgatggagagcgcccgccccgaggacgtgtccttccaggggcggggcgtcttcgagctgagcgacgagaaggccaccaaccccatcgtgccctccttcgacatgagcaacgagggctcctacttcttcggggacaacgccgaggagtacgacaac

SEQ ID NO: 12991 - RNA, 1494 nt, synthetic construct; identical to SEQ ID NO: 12988
  misc_feature 1..1494: note = derived and/or modified sequence opt1 from anti-influenza_Chain
  source 1..1494: mol_type = other RNA

SEQ ID NO: 12992 - RNA, 1494 nt, synthetic construct; identical to SEQ ID NO: 12989
  misc_feature 1..1494: note = derived and/or modified sequence opt1 from anti-influenza_Chain
  source 1..1494: mol_type = other RNA

SEQ ID NO: 12993 - RNA, 1494 nt, synthetic construct; identical to SEQ ID NO: 12990
  misc_feature 1..1494: note = derived and/or modified sequence opt1 from anti-influenza_Chain
  source 1..1494: mol_type = other RNA

SEQ ID NO: 12994 - RNA, 1530 nt, synthetic construct
  misc_feature 1..1530: note = derived and/or modified sequence opt1 from anti-influenza_Chain
  source 1..1530: mol_type = other RNA
atgttccccgagaagttcctgtggggcgtggcccagagcgggttccagttcgagatgggcgacaagctccgccggaacatcgacaccaacaccgactggtggcactgggtccgcgacaagacgaacatcgagaaggggctggtgtccggcgacctgccggaggaggggatcaacaactacgagctctacgagaaggaccacgagatcgcccggaagctgggcctgaacgcgtaccgcatcggcatcgagtggagccggatcttcccctggcccaccaccttcatcgacgtggactactcctacaacgagagctacaacctcatcgaggacgtcaagatcaccaaggacacgctggaggagctggacgagatcgccaacaagcgcgaggtggcctactaccggtccgtgatcaacagcctccgctccaaggggttcaaggtcatcgtgaacctgaaccacttcaccctgccctactggctccacgacccgatcgaggcccgggagcgcgccctgaccaacaagcggaacggctgggtgaacccccgcaccgtcatcgagttcgcgaagtacgccgcctacatcgcctacaagttcggggacatcgtggacatgtggagcacgttcaacgagcccatggtggtcgtggagctgggctacctcgcgccctactccgggttcccgcccggcgtgctgaaccccgaggccgccaagctggccatcctccacatgatcaacgcccacgcgctggcctaccggcagatcaagaagttcgacaccgagaaggccgacaaggacagcaaggagcccgccgaggtcggcatcatctacaacaacatcggggtggcctacccgaaggaccccaacgactccaaggacgtgaaggcggccgagaacgacaacttcttccacagcggcctgttcttcgaggccatccacaaggggaagctcaacatcgagttcgacggcgagaccttcatcgacgccccctacctgaagggcaacgactggatcggggtcaactactacacccgcgaggtggtgacgtaccaggagcccatgttcccgtccatccccctgatcaccttcaagggcgtccaggggtacggctacgcctgccggcccgggaccctcagcaaggacgaccgccccgtgtccgacatcggctgggagctgtacccggagggcatgtacgacagcatcgtggaggcgcacaagtacggggtccccgtgtacgtcaccgagaacggcatcgccgactccaaggacatcctgcggccctactacatcgccagccacatcaagatgacggagaaggccttcgaggacgggtacgaggtgaagggctacttccactgggccctcaccgacaacttcgagtgggcgctggggttccgcatgcggttcggcctgtacgaggtgaacctcatcaccaaggagcgcatcccccgggagaagtccgtcagcatcttccgcgagatcgtggccaacaacggcgtgaccaagaagatcgaggaggagctgctgcgcggg

SEQ ID NO: 12995 - RNA, 1530 nt, synthetic construct; identical to SEQ ID NO: 12994
  misc_feature 1..1530: note = derived and/or modified sequence opt1 from anti-influenza_Chain
  source 1..1530: mol_type = other RNA

SEQ ID NO: 12996 - RNA, 1536 nt, synthetic construct
  misc_feature 1..1536: note = derived and/or modified sequence opt1 from anti-influenza_Chain
  source 1..1536: mol_type = other RNA
atgaagcgcaaggtgaagaagatggccgccatggcgaccagcatcatcatggccatcatgatcatcctgcactccatccccgtcctcgccggccggatcatctacgacaacgagaccgggacgcacggcgggtacgactacgagctgtggaaggactacggcaacaccatcatggagctgaacgacgggggcaccttcagctgccagtggtccaacatcggcaacgccctcttccgcaaggggcggaagttcaacagcgacaagacctaccaggagctgggcgacatcgtggtggagtacgggtgcgactacaacccgaacggcaactcctacctgtgcgtctacgggtggacgcgcaaccccctcgtggagtactacatcgtggagagctggggctcctggcggccgcccggcgccacccccaaggggaccatcacccagtggatggcgggcacgtacgagatctacgagaccacccgcgtcaaccagcccagcatcgacgggaccgccacgttccagcagtactggtccgtgcggaccagcaagcgcacctccggcaccatcagcgtgacggagcacttcaagcagtgggagcggatgggcatgcgcatggggaagatgtacgaggtcgccctgaccgtggagggctaccagtccagcgggtacgccaacgtgtacaagaacgagatccggatcggcgcgaaccccacccccgccccgtcccagagccccatccgccgggacgccttctccatcatcgaggccgaggagtacaacagcaccaactccagcacgctgcaggtcatcgggacccccaacaacggccgcggcatcgggtacatcgagaacggcaacaccgtgacctacagcaacatcgacttcgggtccggcgccacggggttcagcgcgaccgtggccaccgaggtcaacacctccatccagatccggagcgactcccccacgggcaccctcctgggcaccctgtacgtgagctccaccgggagctggaacacgtaccagaccgtgtccaccaacatcagcaagatcaccggcgtccacgacatcgtgctcgtgttctccgggccggtcaacgtggacaacttcatcttcagccgctccagccccgtgcccgcccccggcgacaacacgcgggacgcctactccatcatccaggccgaggactacgacagctcctacgggccgaacctgcagatcttcagcctgcccggcggcgggtccgcgatcggctacatcgagaacgggtacagcaccacctacaagaacatcgacttcggcgacggcgccaccagcgtcaccgcccgcgtggccacgcagaacgccaccaccatccaggtccggctcgggtcccccagcggcaccctgctggggacgatctacgtgggctccaccgggagcttcgacacctaccgcgacgtgtccgcgaccatcagcaacacggccggcgtcaaggacatcgtgctcgtgttctccggccccgtcaacgtggactggttcgtgttcagcaagtccgggacc

SEQ ID NO: 12997 - RNA, 1536 nt, synthetic construct; identical to SEQ ID NO: 12996
  misc_feature 1..1536: note = derived and/or modified sequence opt1 from anti-influenza_Chain
  source 1..1536: mol_type = other RNA

SEQ ID NO: 12998 - RNA, 1539 nt, synthetic construct
  misc_feature 1..1539: note = derived and/or modified sequence opt1 from anti-influenza_Chain
  source 1..1539: mol_type = other RNA
atctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctctcccggatcaaccacttcgagaagatccagatcatccccaagagctcctggagcgaccacgaggcctccagcggcgtctccagcgcctgcccctaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagaacggccgcatggacttcttctggaccatcctgaagcccaacgacgccatcaacttcgagtccaacgggaacttcatcgcgcccgagtacgcctacaagatcgtcaagaagggctacatcccggaggcgccccgggacggccaggcctacgtgcgcaaggacggggagtgggtgctcctgagcaccttcctgcggtccgacaagacccacacgtgcccgccctgcccggcccccgagctcctgggcgggcccagcgtcttcctgttcccgccgaagcccaaggacaccctcatgatcagccgcacccccgaggtgacctgcgtggtcgtggacgtgtcccacgaggaccccgaggtcaagttcaactggtacgtggacggcgtggaggtccacaacgccaagacgaagccgcgggaggagcagtacaacagcacctaccgcgtggtctccgtgctgaccgtgctgcaccaggactggctcaacggcaaggagtacaagtgcaaggtcagcaacaaggccctgcccgcccccatcgagaagaccatctccaaggccaaggggcagccccgggagccccaggtgtacacgctgccgcccagccgcgaggagatgaccaagaaccaggtgtccctgacctgcctggtcaagggcttctaccccagcgacatcgccgtggagtgggagtccaacgggcagcccgagaacaactacaagaccacgccgcccgtgctggacagcgacggctccttcttcctctacagcaagctgaccgtcgacaagtcccggtggcagcaggggaacgtgttcagctgctccgtgatgcacgaggcgctgcacaaccactacacccagaagtccctcagcctgagccccggcaag

SEQ ID NO: 12999 - RNA, 1539 nt, synthetic construct; identical to SEQ ID NO: 12998
  misc_feature 1..1539: note = derived and/or modified sequence opt1 from anti-influenza_Chain
  source 1..1539: mol_type = other RNA

SEQ ID NO: 13000 - RNA, 1593 nt, synthetic construct
  misc_feature 1..1593: note = derived and/or modified sequence opt1 from anti-influenza_Chain
  source 1..1593: mol_type = other RNA
accctgtgcatcggctaccacgccaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctacatcgtggagacctccagctccgacaacgggacctgctaccccggcgacttcatcgactacgaggagctccgggagcagctgagctccgtcagctccttcgagcgcttcgagatcttccccaagaccagctcctggcccaaccacgacagcaacaagggcgtgacggccgcctgcccgcacgccggcgcgaagtccttctacaagaacctgatctggctcgtgaagaaggggaacagctaccccaagctgtccaagagctacatcaacgacaagggcaaggaggtcctggtgctctgggggatccaccaccccagcacctccgccgaccagcagagcctgtaccagaacgccgacgcctacgtgttcgtcggcacctcccggtacagcaagaagttcaagcccgagatcgcgatccgcccgaaggtgcgggaccaggagggccgcatgaactactactggaccctggtggagcccggggacaagatcacgttcgaggccaccggcaacctcgtcgtgccccggtacgccttcgccatggagcgcgacgccgggtccggcatcatcatcagcgacacccccgtgcacgactgcaacaccacgtgccagaccccgaagggcgcgatcaacacctccctgcccttccagaacatccaccccatcaccatcgggaagtgccccaagtacgtcaagagcacgaagctgcggctcgccaccggcctgcgcaacgtgccgtccatccagagccgggggctgttcggcgccatcgccgggttcatcgagggcggctggaccgggatggtggacggctggtacgggtaccaccaccagaacgagcagggctccgggtacgccgcggacctcaagagcacccagaacgccatcgacgagatcacgaacaaggtcaactccgtgatcgagaagatgaacacccagttcaccgccgtgggcaaggagttcaaccacctggagaagcgcatcgagaacctgaacaagaagatcgacgacggcttcctcgacatctggacctacaacgccgagctgctggtcctcctggagaacgagcggacgctggactaccacgacagcaacgtgaagaacctctacgagaaggtccgctcccagctgaagaacaacgccaaggagatcgggaacggctgcttcgagttctaccacaagtgcgacaacacgtgcatggagagcgtgaagaacgggacctacgactaccccaagtactccgaggaggcgaagctgaaccgggaggagatcgacggcgtgaagctcgagagcacccgcatctaccagatcctggccatctactccaccgtcgccagcagcctggtgctcgtggtctccctgggggcc

SEQ ID NO: 13001 - RNA, 1593 nt, synthetic construct
  misc_feature 1..1593: note = derived and/or modified sequence opt1 from anti-influenza_Chain
  source 1..1593: mol_type = other RNA
accctgtgcatcggctaccacgccaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctgcatcgtggagacctccagctccgacaacgggacctgctaccccggcgacttcatcgactacgaggagctccgggagcagctgagctccgtcagctccttcgagcgcttcgagatcttccccaagaccagctcctggcccaaccacgacagcaacaagggcgtgacggccgcctgcccgcacgccggcgcgaagtccttctacaagaacctgatctggctcgtgaagaaggggaacagctaccccaagctgtccaagagctacatcaacgacaagggcaaggaggtcctggtgctctgggggatccaccaccccagcacctccgccgaccagcagagcctgtaccagaacgccgacgcctacgtgttcgtcggcacctcccggtacagcaagaagttcaagcccgagatcgcgatccgcccgaaggtgcgggaccaggagggccgcatgaactactactggaccctggtggagcccggggacaagatcacgttcgaggccaccggcaacctcgtcgtgccccggtacgccttcgccatggagcgcgacgccgggtccggcatcatcatcagcgacacccccgtgcacgactgcaacaccacgtgccagaccccgaagggcgcgatcaacacctccctgcccttccagaacatccaccccatcaccatcgggaagtgccccaagtacgtcaagagcacgaagctgcggctcgccaccggcctgcgcaacgtgccgtccatccagagccgggggctgttcggcgccatcgccgggttcatcgagggcggctggaccgggatggtggacggctggtacgggtaccaccaccagaacgagcagggctccgggtacgccgcggacctcaagagcacccagaacgccatcgacgagatcacgaacaaggtcaactccgtgatcgagaagatgaacacccagttcaccgccgtgggcaaggagttcaaccacctggagaagcgcatcgagaacctgaacaagaagatcgacgacggcttcctcgacatctggacctacaacgccgagctgctggtcctcctggagaacgagcggacgctggactaccacgacagcaacgtgaagaacctctacgagaaggtccgctcccagctgaagaacaacgccaaggagatcgggaacggctgcttcgagttctaccacaagtgcgacaacacgtgcatggagagcgtgaagaacgggacctacgactaccccaagtactccgaggaggcgaagctgaaccgggaggagatcgacggcgtgaagctcgagagcacccgcatctaccagatcctggccatctactccaccgtcgccagcagcctggtgctcgtggtctccctgggggcc

SEQ ID NO: 13002 - RNA, 1593 nt, synthetic construct
  misc_feature 1..1593: note = derived and/or modified sequence opt1 from anti-influenza_Chain
  source 1..1593: mol_type = other RNA
accctgtgcatcggctaccacgccaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctacatcgtggagacctccagctccgacaacgggacctgctaccccggcgacttcatcgactacgaggagctccgggagcagctgagctccgtcagctccttcgagcgcttcgagatcttccccaacaccagctcctggcccaaccacgacagcaacaagggcgtgacggccgcctgcccgcacgccggcgcgaagtccttctacaagaacctgatctggctcgtgaagaaggggaacagctaccccaagctgtccaagagctacatcaacgacaagggcaaggaggtcctggtgctctgggggatccaccaccccagcacctccgccgaccagcagagcctgtaccagaacgccgacgcctacgtgttcgtcggcacctcccggtacagcaagaagttcaagcccgagatcgcgatccgcccgaaggtgcgggaccaggagggccgcatgaactactactggaccctggtggagcccggggacaagatcacgttcgaggccaccggcaacctcgtcgtgccccggtacgccttcgccatggagcgcgacgccgggtccggcatcatcatcagcgacacccccgtgcacgactgcaacaccacgtgccagaccccgaagggcgcgatcaacacctccctgcccttccagaacatccaccccatcaccatcgggaagtgccccaagtacgtcaagagcacgaagctgcggctcgccaccggcctgcgcaacgtgccgtccatccagagccgggggctgttcggcgccatcgccgggttcatcgagggcggctggaccgggatggtggacggctggtacgggtaccaccaccagaacgagcagggctccgggtacgccgcggacctcaagagcacccagaacgccatcgacgagatcacgaacaaggtcaactccgtgatcgagaagatgaacacccagttcaccgccgtgggcaaggagttcaaccacctggagaagcgcatcgagaacctgaacaagaagatcgacgacggcttcctcgacatctggacctacaacgccgagctgctggtcctcctggagaacgagcggacgctggactaccacgacagcaacgtgaagaacctctacgagaaggtccgctcccagctgaagaacaacgccaaggagatcgggaacggctgcttcgagttctaccacaagtgcgacaacacgtgcatggagagcgtgaagaacgggacctacgactaccccaagtactccgaggaggcgaagctgaaccgggaggagatcgacggcgtgaagctcgagagcacccgcatctaccagatcctggccatctactccaccgtcgccagcagcctggtgctcgtggtctccctgggggcc

SEQ ID NO: 13003 - RNA, 1593 nt, synthetic construct
  misc_feature 1..1593: note = derived and/or modified sequence opt1 from anti-influenza_Chain
  source 1..1593: mol_type = other RNA
accctgtgcatcggctaccacgccaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctacatcgtggagacctccagctccgacaacgggacctgctaccccggcgacttcatcgactacgaggagctccgggagcagctgagctccgtcagctccttcgagcgcttcgagatcttccccaagaccagctcctggcccaaccacgacagcaacaagggcgtgacggccgcctgcccgcacgccggcgcgaagtccttctacaagaacctgatctggctcgtgaagaaggggaacagctaccccaagctgtccaagagctacatcaacgacaagggcaaggaggtcctggtgctctgggggatccaccaccccagcacctccgccgaccagcagagcctgtaccagaacgccgacgcctacgtgttcgtcggcacctcccggtacagcaagaagttcggccccgagatcgcgatccgcccgaaggtgcgggaccaggaggggcgcatgaactactactggaccctggtggagcccggcgacaagatcacgttcgaggccaccgggaacctcgtcgtgccccggtacgccttcgccatggagcgcgacgccggctccggcatcatcatcagcgacacccccgtgcacgactgcaacaccacgtgccagaccccgaagggggcgatcaacacctccctgcccttccagaacatccaccccatcaccatcggcaagtgccccaagtacgtcaagagcacgaagctgcggctcgccaccgggctgcgcaacgtgccgtccatccagagccggggcctgttcggggccatcgccggcttcatcgagggcgggtggaccggcatggtggacgggtggtacggctaccaccaccagaacgagcaggggtccggctacgccgcggacctcaagagcacccagaacgccatcgacgagatcacgaacaaggtcaactccgtgatcgagaagatgaacacccagttcaccgccgtgggcaaggagttcaaccacctggagaagcgcatcgagaacctgaacaagaagatcgacgacgggttcctcgacatctggacctacaacgccgagctgctggtcctcctggagaacgagcggacgctggactaccacgacagcaacgtgaagaacctctacgagaaggtccgctcccagctgaagaacaacgccaaggagatcggcaacgggtgcttcgagttctaccacaagtgcgacaacacgtgcatggagagcgtgaagaacggcacctacgactaccccaagtactccgaggaggcgaagctgaaccgggaggagatcgacggggtgaagctcgagagcacccgcatctaccagatcctggccatctactccaccgtcgccagcagcctggtgctcgtggtctccctgggcgcc

SEQ ID NO: 13004 - RNA, 1593 nt, synthetic construct; identical to SEQ ID NO: 13000
  misc_feature 1..1593: note = derived and/or modified sequence opt1 from anti-influenza_Chain
  source 1..1593: mol_type = other RNA

SEQ ID NO: 13005 - RNA, 1593 nt, synthetic construct; identical to SEQ ID NO: 13001
  misc_feature 1..1593: note = derived and/or modified sequence opt1 from anti-influenza_Chain
  source 1..1593: mol_type = other RNA

SEQ ID NO: 13006 - RNA, 1593 nt, synthetic construct; identical to SEQ ID NO: 13002
  misc_feature 1..1593: note = derived and/or modified sequence opt1 from anti-influenza_Chain
  source 1..1593: mol_type = other RNA

SEQ ID NO: 13007 - RNA, 1593 nt, synthetic construct; identical to SEQ ID NO: 13003
  misc_feature 1..1593: note = derived and/or modified sequence opt1 from anti-influenza_Chain
  source 1..1593: mol_type = other RNA

SEQ ID NO: 13008 - RNA, 1605 nt, synthetic construct
  misc_feature 1..1605: note = derived and/or modified sequence opt1 from anti-influenza_Chain
  source 1..1605: mol_type = other RNA
gccaacgccgacaccctgtgcatcggctaccacgcgaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctacatcgtggagacctccagctccgacaacgggacctgctaccccggcgacttcatcgactacgaggagctccgggagcagctgagctccgtcagctccttcgagcgcttcgagatcttccccaagaccagctcctggcccgaccacgacagcaacaagggcgtgacggccgcctgcccgcacgccggcgccaagtccttctacaagaacctgatctggctcgtgaagaaggggaacagctaccccaagctgtccaagagctacatcaacgacaagggcaaggaggtcctggtgctctgggggatccaccaccccagcacctccgccgaccagcagagcctgtaccagaacgcggacgcctacgtgttcgtcggcacctcccggtacagcaagaagttcaagcccgagatcgccatccgcccgaaggtgcgggaccaggagggccgcatgaactactactggaccctggtggagcccggggacaagatcacgttcgaggccaccggcaacctcgtcgtgccccggtacgccttcgcgatggagcgcaacgccgggtccggcatcatcatcagcgacacccccgtgcacgactgcaacaccacgtgccagaccccgaagggcgccatcaacacctccctgcccttccagaacatccaccccatcaccatcgggaagtgccccaagtacgtcaagagcacgaagctgcggctcgccaccggcctgcgcaacgtgccgtccatccagagccgggggctgttcggcgccatcgcggggttcatcgagggcggctggaccgggatggtggacggctggtacgggtaccaccaccagaacgagcagggctccgggtacgccgccgacctcaagagcacccagaacgccatcgacaagatcacgaacaaggtcaactccgtgatcgagaagatgaacacccagttcaccgccgtgggcaaggagttcaaccacctggagaagcgcatcgagaacctgaacaagaaggtcgacgacggcttcctcgacatctggacctacaacgcggagctgctggtgctcctggagaacgagcggacgctggactaccacgacagcaacgtcaagaacctctacgagaaggtgcgctcccagctgaagaacaacgccaaggagatcgggaacggctgcttcgagttctaccacaagtgcgacaacacgtgcatggagagcgtgaagaacgggacctacgactaccccaagtactccgaggaggccaagctgaaccgggaggagatcgacggcgtcaagctcgagagcacccgcatctaccagatcctggccatctactccaccgtggccagcagcctggtgctcgtcgtgtccctgggggcg

SEQ ID NO: 13009 - RNA, 1605 nt, synthetic construct
  misc_feature 1..1605: note = derived and/or modified sequence opt1 from anti-influenza_Chain
  source 1..1605: mol_type = other RNA
gccaacgccgacaccctgtgcatcggctaccacgcgaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgccggctggatcctggggaacccggagtgcgagagcctgtccacggccagctcctggagctacatcgtggagacctccagctccgacaacgggacctgctaccccggcgacttcatcgactacgaggagctccgggagcagctgagctccgtcagctccttcgagcgcttcgagatcttccccaagaccagctcctggcccaaccacgacagcaacaagggcgtgacggccgcctgcccgcgggccggcgccaaggggttctacaagaacctgatctggctcgtgaagaagggcaactcctaccccaagctgaacaagagctacatcaacgacaaggggaaggaggtcctggtgctctggggcatccaccacccctccaccaccgccgaccagcagagcctgtaccagaacgcggacacctacgtgttcgtcggcacgagccgctactccaagaagttcaagcccgagatcgagatccggccgaaggtgcgcgaccaggaggggcggatgaactactactggaccctggtggagcccggcgacaagatcaccttcgaggccaccgggaacctcgtcgtgccccgctacgccttcgccatggagcggaacgccggcagcggcatcatcatctccgacacgcccgtgcacgactgcaacacgacctgccagaccccgaagggggcgatcaacaccagcctgcccttccagaacatccaccccatcaccatcggcaagtgccccaagtacgtcaagtccaccaagctgcgcctcgccaccgggctgcggaacgtgccgagcatccagtcccgcggcctgttcggggccatcgccggcttcatcgagggcgggtggacgggcatggtggacgggtggtacggctaccaccaccagaacgagcaggggagcggctacgccgcggacctcaagtccacccagaacgccatcgacaagatcaccaacaaggtcaacagcgtgatcgagaagatgaacacccagttcacggccgtggacaaggagttcaaccacctggagaagcggatcgagaacctgaacaagaaggtcgacgacggcttcctcgacatctggacctacaacgccgagctgctggtgctcctggagaacgagcgcaccctggactaccacgactccaacgtcaagaacctctacgagaaggtgcggaaccagctgaagaacaacgccaaggagatcgggaacggctgcttcgagttctaccacaagtgcgacaacacgtgcatggagagcgtgaagaacgggacctacgactaccccaagtactccgaggaggcgaagctgaaccgcgaggagatcgacggcgtcaagctcgagagcacccggatctaccagatcctggccatctactccaccgtggccagctccctggtgctcgtcgtgagcctgggggcc

SEQ ID NO: 13010 - RNA, 1605 nt, synthetic construct; identical to SEQ ID NO: 13008
  misc_feature 1..1605: note = derived and/or modified sequence opt1 from anti-influenza_Chain
  source 1..1605: mol_type = other RNA

SEQ ID NO: 13011 - RNA, 1605 nt, synthetic construct; identical to SEQ ID NO: 13009
  misc_feature 1..1605: note = derived and/or modified sequence opt1 from anti-influenza_Chain
  source 1..1605: mol_type = other RNA

SEQ ID NO: 13012 - RNA, 1644 nt, synthetic construct
  misc_feature 1..1644: note = derived and/or modified sequence opt1 from anti-influenza_Chain
  source 1..1644: mol_type = other RNA
cagaagctgcccggcaacgacaacagcaccgccaccctctgcctggggcaccacgccgtgccgaacggcacgatcgtcaagaccatcaccaacgaccagatcgaggtgaccaacgcgacggagctggtgcagtccagctccaccggggagatctgcgacagcccccaccagatcctcgacggcgagaactgcaccctgatcgacgccctgctcggggacccccagtgcgacggcttccagaacaagaagtgggacctgttcgtcgagcgctccaaggcctacagcaactgctacccctacgacgtgccggactacgcctccctgcggagcctcgtggcctccagcggcaccctggagttcaacaacgagtccttcaactggacgggggtcacccagaacggcaccagctccgcgtgcatccgccggagcaacaactccttcttcagccgcctgaactggctcacccacctgaagttcaagtaccccgccctgaacgtgacgatgcccaacaacgagaagttcgacaagctctacatctggggcgtgcaccaccccgggaccgacaacgaccagatcttcccgtacgcccaggcctccgggcggatcaccgtcagcaccaagcgctcccagcagacggtgatccccaacatcggcagccggccccgcgtgcggaacatccccagccgcatctccatctactggaccatcgtcaagccgggcgacatcctgctgatcaacagcaccgggaacctcatcgcgccccggggctacttcaagatccgctccggcaagagctccatcatgcggagcgacgcccccatcgggaagtgcaactccgagtgcatcacccccaacggcagcatcccgaacgacaagcccttccagaacgtgaaccgcatcacgtacggggcctgcccccggtacgtgaagcagaacaccctgaagctggccaccggcatgcgcaacgtccccgagaagcagacccgggggatcttcggcgccatcgcggggttcatcgagaacggctgggagggcatggtggacgggtggtacggcttccgccaccagaactccgaggggatcggccaggccgccgacctcaagagcacgcaggccgccatcgaccagatcaacgggaagctgaaccggctgatcggcaagaccaacgagaagttccaccagatcgagaaggagttctccgaggtggagggccgcatccaggacctcgagaagtacgtcgaggacaccaagatcgacctgtggagctacaacgcggagctgctcgtggccctggagaaccagcacaccatcgacctgacggactccgagatgaacaagctgttcgagaagaccaagaagcagctccgggagaacgccgaggacatggggaacggctgcttcaagatctaccacaagtgcgacaacgcctgcatcgggagcatccgcaacggcacctacgaccacgacgtgtaccgcgacgaggccctgaacaaccggttccagatcaagggggtcgagctcaagtccggctacaaggactggatcctgtggatcagcttcgcgatctcctgcttcctgctctgcgtggccctgctgggcttcatcatgtgggcctgccagaaggggaacatccgctgcaacatc

SEQ ID NO: 13013 - RNA, 1644 nt, synthetic construct; identical to SEQ ID NO: 13012
  misc_feature 1..1644: note = derived and/or modified sequence opt1 from anti-influenza_Chain
  source 1..1644: mol_type = other RNA

SEQ ID NO: 13014 - RNA, 1647 nt, synthetic construct
  misc_feature 1..1647: note = derived and/or modified sequence opt1 from anti-influenza_Chain
  source 1..1647: mol_type = other RNA
atgctgaccttccaccgcatcatccggaagggctggatgttcctcctggccttcctgctcaccgccctgctgttctgccccacggggcagccggcgaaggccgccgcccccttcaacggcaccatgatgcagtacttcgagtggtacctccccgacgacgggaccctgtggaccaaggtggccaacgaggcgaacaacctgagctccctcggcatcacggccctgtggctgcccccggcctacaaggggaccagccgctccgacgtcggctacggcgtgtacgacctctacgacctgggggagttcaaccagaagggcgccgtgcggaccaagtacgggaccaaggcgcagtacctgcaggccatccaggccgcccacgccgcgggcatgcaggtctacgccgacgtggtgttcgaccacaagggcggggccgacggcacggagtgggtcgacgccgtggaggtgaaccccagcgaccgcaaccaggagatctccgggacctaccagatccaggcctggaccaagttcgacttccccggccgggggaacacctacagctccttcaagtggcgctggtaccacttcgacggcgtcgactgggacgagagccggaagctctcccgcatctacaagttccggggcatcgggaaggcgtgggactgggaggtggacacggagaacggcaactacgactacctgatgtacgccgacctggacatggaccaccccgaggtggtcaccgagctcaagagctgggggaagtggtacgtgaacaccaccaacatcgacggcttccgcctggacgccgtgaagcacatcaagttctccttcttcccggactggctgagcgacgtccggtcccagacggggaagcccctcttcaccgtgggcgagtactggagctacgacatcaacaagctgcacaactacatcatgaagaccaacggcaccatgtccctgttcgacgcgcccctccacaacaagttctacacggccagcaagtccgggggcaccttcgacatgcgcaccctgatgaccaacacgctgatgaaggaccagcccaccctcgccgtgaccttcgtcgacaaccacgacaccgagccggggcaggccctgcagagctgggtggacccctggttcaagcccctggcctacgccttcatcctcacgcggcaggagggctacccctgcgtgttctacggggactactacggcatcccgcagtacaacatcccctccctcaagagcaagatcgaccccctgctgatcgcccgccgggactacgcgtacggcacccagcacgactacctggaccacagcgacatcatcgggtggacccgcgagggcgtcaccgagaagcccgggtccggcctggccgccctcatcacggacgggccgggcggcagcaagtggatgtacgtggggaagcagcacgccggcaaggtgttctacgacctgaccgggaaccggtccgacaccgtcaccatcaacagcgacggctggggcgagttcaaggtgaacgggggctccgtcagcgtgtgggtgccccgcaagacgaccgtctccaccatcgcgtggagcatcaccacccggccctggacggacgagttcgtgcgctggaccgagccccggctggtggcctggccg

SEQ ID NO: 13015 - RNA, 1647 nt, synthetic construct
  misc_feature 1..1647: note = derived and/or modified sequence opt1 from anti-influenza_Chain
  source 1..1647: mol_type = other RNA
atctgcatcggctaccacgccaacaacagcaccgagcaggtcgacaccatcatggagaagaacgtcacggtgacccacgcccaggacatcctggagaagacccacaacgggaagctctgcgacctggacggcgtgaagcccctgatcctccgcgactgctccgtcgcggggtggctgctgggcaaccccatgtgcgacgagttcatcaacgtgcccgagtggagctacatcgtggagaaggccaaccccgccaacgacctctgctaccccgggaacttcaacgactacgaggagctgaagcacctcctgtcccggatcaaccacttcgagaagatccagatcatccccaagagctcctggagcgaccacgaggcctccagcggcgtctccagcgcctgcccctaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagaacggccgcatggacttcttctggaccatcctgaagcccaacgacgccatcaacttcgagtccaacgggaacttcatcgcgcccgagtacgcctacaagatcgtcaagaagggcgacagcgccatcgtgaagtccgaggtggagtacggcaactgcaacaccaagtgccagaccccgatcggggccatcaacagcagcatgcccttccacaacatccaccccctcacgatcggcgagtgccccaagtacgtcaagtccaacaagctggtgctggccaccgggctccggaacagcccgctgcgctccgacaagacccacacgtgcccgccctgccccgcgccggagctgctcggcggccccagcgtgttcctgttcccgcccaagcccaaggacaccctgatgatctcccggacccccgaggtgacctgcgtggtggtcgacgtgagccacgaggaccccgaggtgaagttcaactggtacgtcgacggggtggaggtccacaacgccaagaccaagccccgcgaggagcagtacaactccacgtaccgggtggtgagcgtcctcaccgtgctgcaccaggactggctgaacggcaaggagtacaagtgcaaggtgtccaacaaggccctcccggcccccatcgagaagaccatcagcaaggccaaggggcagccccgcgagccgcaggtctacaccctgccgccctcccgggaggagatgacgaagaaccaggtgagcctgacctgcctcgtgaagggcttctacccctccgacatcgcggtcgagtgggagagcaacgggcagcccgagaacaactacaagaccaccccgcccgtgctggactccgacggcagcttcttcctgtactccaagctcacggtggacaagagccgctggcagcagggcaacgtcttctcctgcagcgtgatgcacgaggccctgcacaaccactacacccagaagtccctgagcctcagccccgggaag

SEQ ID NO: 13016 - RNA, 1647 nt, synthetic construct; identical to SEQ ID NO: 13015
  misc_feature 1..1647: note = derived and/or modified sequence opt1 from anti-influenza_Chain
  source 1..1647: mol_type = other RNA

SEQ ID NO: 13017 - RNA, 1647 nt, synthetic construct; identical to SEQ ID NO: 13014
  misc_feature 1..1647: note = derived and/or modified sequence opt1 from anti-influenza_Chain
  source 1..1647: mol_type = other RNA

SEQ ID NO: 13018 - RNA, 1650 nt, synthetic construct
  misc_feature 1..1650: note = derived and/or modified sequence opt1 from anti-influenza_Chain
  source 1..1650: mol_type = other RNA
gaccagatctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccaccaacgacctctgctaccccgggtccttcaacgactacgaggagctgaagcacctcctgagccggatcaaccacttcgagaagatccagatcatcccgaagtccagctggtccgaccacgaggccagctccggcgtcagctccgcctgcccctacctgggcagcccctccttcttccgcaacgtggtgtggctgatcaagaagaacagcacgtaccccaccatcaagaagtcctacaacaacaccaaccaggaggacctcctggtcctgtgggggatccaccacccgaacgacgccgcggagcagacccggctctaccagaaccccacgacctacatcagcatcggcacctccaccctgaaccagcgcctggtgcccaagatcgccacgcggagcaaggtgaacgggcagtccggccgcatggagttcttctgggccatcctcaagcccaacgacgccatcaacttcgagagcaacgggaacttcatcgcgccggagtacgcctacaagatcgtcaagaagggcgacagcgccatcatgaagtccgagctggagtacggcaactgcaacaccaagtgccagacccccatgggggccatcaacagctccatgcccttccacaacatccaccccctgaccatcggcgagtgcccgaagtacgtgaagtccaaccggctcgtgctggccacggggctgcgcaacagcccccagcgggagagccgccggaagaagcgcggcctcttcggcgcgatcgccgggttcatcgagggcgggtggcagggcatggtcgacgggtggtacggctaccaccactccaacgagcagggcagcgggtacgccgccgacaaggagtccacccagaaggccatcggcgtgaccaacaaggtgaacagcatcatcgacaagatgaacacccagttcgaggcggtcgggcgggagttcaacaacctggagcgccggatcgagaacctgaacaagaagatggaggacggcttcctcgacgtgtggacgtacaacgccgagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcatccggaacggcacctacaacccccagtactccgaggaggcccgcctcaagcgggaggagatcagcggggtgaagctggagtccatcggcacctaccagatcctgagcatctactccacggtcgccagctccctcgcgctggccatcatgatcgccgggctgagcctctggatgtgcagcaacggctccctgcagtgccgcatctgcatc

SEQ ID NO: 13019 - RNA, 1650 nt, synthetic construct; identical to SEQ ID NO: 13018
  misc_feature 1..1650: note = derived and/or modified sequence opt1 from anti-influenza_Chain
  source 1..1650: mol_type = other RNA

SEQ ID NO: 13020 - RNA, 1656 nt, synthetic construct
  misc_feature 1..1656: note = derived and/or modified sequence opt1 from anti-influenza_Chain
  source 1..1656: mol_type = other RNA
atgaacatccagatcctggccttcatcgcctgcgtgctcaccggcgcgaagggggacaagatctgcctgggccaccacgccgtcgccaacgggaccaaggtgaacacgctgaccgagaagggcatcgaggtggtcaacgccaccgagaccgtggagacggccgacgtgaagaagatctgcacccaggggaagcgcgcgaccgacctcggccggtgcggcctgctggggaccctcatcgggcccccgcagtgcgaccagttcctggagttcagctccgacctgatcatcgagcgccgggagggcacggacgtctgctaccccggccgcttcaccaacgaggagagcctccggcagatcctgcgccggtccgggggcatcggcaaggagagcatggggttcacctactccggcatccgcaccaacggggccgccagcgcctgcacgcggtccggcagctccttctacgcggagatgaagtggctgctcagcaactccgacaacagcgccttcccccagatgaccaaggcctaccgcaacccccggaacaagccggccctgatcatctggggcgtgcaccactccgagagcgcctccgagcagaccaagctgtacgggagcggcaacaagctcatcaccgtgcgctccagcaagtaccagcagtccttcacgcccagccccgggacccggcgcatcgacttccactggctgctgctcgaccccaacgacaccgtcaccttcacgttcaacggcgcgttcatcgccccggaccgggccagcttcttccgcggggagtccctgggcgtgcagagcgacgcgcccctggactccagctgccggggcgactgcttccactccgggggcaccatcgtgagctccctccccttccagaacatcaacagccgcaccgtcgggcggtgcccccgctacgtgaagcagaagtccctgctgctcgccaccggcatgcggaacgtgccggagaagcccaagccccgcgggctgttcggcgccatcgccggcttcatcgagaacgggtgggagggcctgatcaacgggtggtacggcttccgccaccagaacgcccagggggagggcacggccgccgactacaagagcacccagtccgcgatcgaccagatcaccggcaagctcaaccggctgatcgggaagaccaaccagcagttcgagctgatcgacaacgagttcaacgagatcgagcagcagatcggcaacgtcatcaactggacgcgcgacgccatgaccgagatctggagctacaacgccgagctcctggtggccatggagaaccagcacaccatcgacctggccgactccgagatgagcaagctctacgagcgggtgaagaagcagctgcgcgagaacgcggaggaggacgggaccggctgcttcgagatcttccacaagtgcgacgaccagtgcatggagtccatccggaacaacacgtacgaccacacccagtaccgcaccgagagcctgcagaaccggatccagatcgaccccgtcaagctctccagcggctacaaggacatcatcctgtggttctccttcggggccagctgcttcatcctgctcgccatcgccatgggcctggtgttcatctgcatcaagaacgggaacatgcagtgcaccatctgcatc

SEQ ID NO: 13021 - RNA, 1656 nt, synthetic construct
  misc_feature 1..1656: note = derived and/or modified sequence opt1 from anti-influenza_Chain
  source 1..1656: mol_type = other RNA
atgaacacccagatcctggccttcatcgcctgcgtgctcaccggcgtcaagggggacaagatctgcctgggccaccacgcggtggccaacgggacgaaggtgaacaccctgaccgagaagggcatcgaggtcgtgaacgccaccgagacggtggagaccgccgacgtcaagaagatctgcacccaggggaagcgcgccaccgacctcggccggtgcggcctgctggggacgctcatcgggcccccgcagtgcgaccagttcctggagttcagctccgacctgatcatcgagcgccgggagggcaccgacgtgtgctaccccggccgcttcaccaacgaggagagcctccggcagatcctgcgccggtccgggggcatcggcaaggagagcatggggttcacctactccggcatccgcacgaacggggcgaccagcgcctgcacccggtccggcagctccttctacgccgagatgaagtggctgctcagcaactccgacaacagcgccttcccccagatgaccaaggcgtaccgcaacccccggaacaagccggccctgatcatctggggcgtgcaccactccgagagcgtctccgagcagacgaagctgtacgggagcggcaacaagctcatcaccgtgcgctccagcaagtaccagcagtccttcacccccagccccggggcccggcgcatcgacttccactggctgctgctcgaccccaacgacaccgtgacgttcaccttcaacggcgccttcatcgccccggaccgggcgagcttcttccgcggggagtccctgggcgtccagagcgacgtgcccctggactccagctgccggggcgactgcttccactccgggggcaccatcgtgagctccctccccttccagaacatcaacagccgcaccgtcgggaagtgcccccggtacgtgaagcagaagtccctgctgctcgccacgggcatgcgcaacgtgccggagaagcccaagccccgggggctgttcggcgccatcgccggcttcatcgagaacgggtgggagggcctgatcaacgggtggtacggcttccgccaccagaacgcccagggggagggcaccgcggccgactacaagagcacccagtccgccatcgaccagatcaccggcaagctcaaccgcctgatcgggaagacgaaccagcagttcgagctgatcgacaacgagttcaacgagatcgagcagcagatcggcaacgtcatcaactggacccgggacgccatgaccgagatctggagctacaacgccgagctcctggtggcgatggagaaccagcacaccatcgacctggccgactccgagatgagcaagctctacgagcgcgtgaagaagcagctgcgggagaacgccgaggaggacgggacgggctgcttcgagatcttccacaagtgcgacgaccagtgcatggagtccatccgcaacaacacctacgaccacacccagtaccggaccgagagcctgcagaaccgcatccagatcgaccccgtcaagctctccagcggctacaaggacatcatcctgtggttctccttcggggccagctgcttcctgctcctggccatcgcgatgggcctggtgttcatctgcatcaagaacgggaacatgcagtgcacgatctgcatc

SEQ ID NO: 13022 - RNA, 1656 nt, synthetic construct
  misc_feature 1..1656: note = derived and/or modified sequence opt1 from anti-influenza_Chain
  source 1..1656: mol_type = other RNA
atgaacatccagatcctggccttcatcgcctgcgtgctcaccggcgcgaagggggacaagatctgcctgggccaccacgccgtcgccaacgggaccaaggtgaacacgctgaccgagaagggcatcgaggtggtcaacgccaccgagaccgtggagacggccaacatcaagaagatctgcacccaggggaagcgccccaccgacctcggccagtgcggcctgctggggaccctcatcggcccgccccagtgcgaccagttcctggagttcagctccgacctgatcatcgagcggcgcgaggggacggacgtgtgctaccccggcaagttcaccaacgaggagagcctccggcagatcctgcgccggtccgggggcatcggcaaggagagcatggggttcacctactccggcatccgcaccaacggggcgacgagcgcctgcacccggtccggcagctccttctacgccgagatgaagtggctgctcagcaactccgacaacgccgcgttcccccagatgaccaagagctaccgcaacccgcggaacaagcccgccctgatcatctggggcgtccaccactccgagagcgtgtccgagcagaccaagctgtacgggagcggcaacaagctcatcaaggtgcgctccagcaagtaccagcagtccttcacgcccaaccccggggcccggcgcatcgacttccactggctgctgctcgacccgaacgacaccgtcaccttcaccttcaacggcgccttcatcgcccccgaccgggcgagcttcttccgcggggagagcatcggcgtgcagtccgacgcgcccctggacagctcctgcggcgggaactgcttccacaacggcgggacgatcgtgagctccctgcccttccagaacatcaacccgcggaccgtcggcaagtgcccccgctacgtgaagcagaagtccctcctgctggccaccgggatgcggaacgtgcccgagaagcccaagaagcgcggcctcttcggcgccatcgccgggttcatcgagaacggctgggaggggctgatcaacggctggtacgggttccggcaccagaacgcccagggcgagggcaccgccgccgactacaagagcacgcagagcgccatcgaccagatcaccgggaagctgaaccgcctcatcggcaagaccaaccagcagttcgagctgatcaacaacgagttcaacgaggtcgagcagcagatcgggaacgtgatcaactggacccaggacgccatgacggaggtgtggtcctacaacgcggagctgctcgtcgccatggagaaccagcacaccatcgacctgaccgacagcgagatgtccaagctgtacgagcgggtgcgcaagcagctccgcgagaacgccgaggaggacggcaccggctgcttcgagatcttccacaagtgcgacgaccactgcatggagagcatccggaacaacacgtacgaccacacccagtaccgcaccgagtccctgcagaaccggatccagatcgacccggtgaagctgagcgggggctacaaggacatcatcctctggttctccttcggggccagctgcttcctgctgctcgccatcgcgatgggcctggtcttcatctgcatcaagaacgggaacatgcagtgcaccatctgcatc

SEQ ID NO: 13023 - RNA, 1656 nt, synthetic construct
  misc_feature 1..1656: note = derived and/or modified sequence opt1 from anti-influenza_Chain
  source 1..1656: mol_type = other RNA
gaccagatctgcatcggctaccacgccaacaacagcaccgagcaggtcgacaccatcatggagaagaacgtgacggtgacccacgcccagaacatcctggagaagacccacaacgggaagctctgcgacctggacggcgtgaagcccctgatcctccgcgactgctccgtcgcggggtggctgctgggcaacccgatgtgcgacgagttcctcaacgtgcccgagtggagctacatcgtggagaagatcaaccccgccaacgacctgtgctaccccgggaacttcaacgactacgaggagctgaagcacctcctgtcccggatcaaccacttcgagaagatccagatcatccccaagagctcctggagcgaccacgaggcctccagcggcgtctccagcgcctgcccgtaccagggccgctccagcttcttccggaacgtggtgtggctgatcaagaaggacaacgcctaccccaccatcaagcgctcctacaacaacacgaaccaggaggacctcctggtcctgtgggggatccaccaccccaacgacgcggccgagcagacccggctctaccagaacccgaccacctacatcagcgtgggcacgtccaccctgaaccagcgcctggtgcccaagatcgccacccggagcaaggtcaacgggcagtccggccgcatggagttcttctggaccatcctcaagcccaacgacgccatcaacttcgagagcaacgggaacttcatcgcgcccgagaacgcctacaagatcgtgaagaagggcgactccacgatcatgaagtccgagctggagtacggcaactgcaacaccaagtgccagaccccgatcggggccatcaacagcagcatgcccttccacaacatccaccccctgaccatcggcgagtgccccaagtacgtcaagagcaacaagctcgtgctggccacggggctgcggaactccccgcagggcgagcgccggcgcaagaagcggggcctcttcggggccatcgcgggcttcatcgagggcgggtggcaggggatggtggacggctggtacggctaccaccacagcaacgagcaggggtccggctacgccgccgacaaggagagcacccagaaggccatcgacggggtgaccaacaaggtcaactccatcatcgacaagatgaacacccagttcgaggccgtgggccgcgagttcaacaacctggagcggcgcatcgagaacctgaacaagaagatggaggacgggttcctcgacgtgtggacgtacaacgcggagctgctggtcctcatggagaacgagcggaccctggacttccacgacagcaacgtgaagaacctgtacgacaagatccgcctccagctgcgggacaacgccaaggagctgggcaacggctgcttcgagttctaccaccgctgcgacaacgagtgcatggagtccgtgcggaacgggacctacgactacccccagtacagcgaggaggcccgcctcaagcgcgaggagatctccggcgtcaagctggagagcatcgggacctaccagatcctgtccatctacagcacggtggcctccagcctcaccctggccatcatggtcgcgggcctgtccctctggatgtgcagcaacgggtccctgcagtgccggatctgcatc

SEQ ID NO: 13024 - RNA, 1656 nt, synthetic construct
  misc_feature 1..1656: note = derived and/or modified sequence opt1 from anti-influenza_Chain
  source 1..1656: mol_type = other RNA
gaccagatctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccaccaacgacctctgctaccccgggtccttcaacgactacgaggagctgaagcacctcctgagccggatcaaccacttcgagaagatccagatcatcccgaagtccagctggtccgaccacgaggccagctccggcgtcagctccgcctgcccctacctgggcagcccctccttcttccgcaacgtggtgtggctgatcaagaagaacagcacgtaccccaccatcaagaagtcctacaacaacaccaaccaggaggacctcctggtcctgtgggggatccaccacccgaacgacgccgcggagcagacccggctctaccagaaccccacgacctacatcagcatcggcacctccaccctgaaccagcgcctggtgcccaagatcgccacgcggagcaaggtgaacgggcagtccggccgcatggagttcttctggaccatcctcaaccccaacgacgccatcaacttcgagagcaacgggaacttcatcgccccggagtacgcgtacaagatcgtcaagaagggcgacagcgccatcatgaagtccgagctggagtacggcaactgcaacaccaagtgccagacccccatgggggccatcaacagctccatgcccttccacaacatccaccccctgacgatcggcgagtgcccgaagtacgtgaagtccaaccggctcgtgctggccaccgggctgcgcaacagcccccagcgggagagccgccggaagaagcgcggcctcttcggcgccatcgcggggttcatcgagggcgggtggcagggcatggtcgacgggtggtacggctaccaccactccaacgagcagggcagcgggtacgccgccgacaaggagtccacccagaaggccatcgacggcgtgaccaacaaggtgaacagcatcatcgacaagatgaacacgcagttcgaggccgtcgggcgggagttcaacaacctggagcgccggatcgagaacctgaacaagaagatggaggacggcttcctcgacgtgtggacctacaacgcggagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcatccggaacggcacctacaactacccccagtactccgaggaggcccgcctcaagcgggaggagatcagcggggtgaagctggagtccatcggcacgtaccagatcctgagcatctactccaccgtcgccagctccctcgccctggcgatcatgatggccgggctgagcctctggatgtgcagcaacggctccctgcagtgccgcatctgcatc

SEQ ID NO: 13025 - RNA, 1656 nt, synthetic construct; identical to SEQ ID NO: 13020
  misc_feature 1..1656: note = derived and/or modified sequence opt1 from anti-influenza_Chain
  source 1..1656: mol_type = other RNA

SEQ ID NO: 13026 - RNA, 1656 nt, synthetic construct; identical to SEQ ID NO: 13021
  misc_feature 1..1656: note = derived and/or modified sequence opt1 from anti-influenza_Chain
  source 1..1656: mol_type = other RNA

SEQ ID NO: 13027 - RNA, 1656 nt, synthetic construct; identical to SEQ ID NO: 13022
  misc_feature 1..1656: note = derived and/or modified sequence opt1 from anti-influenza_Chain
  source 1..1656: mol_type = other RNA

SEQ ID NO: 13028 - RNA, 1656 nt, synthetic construct; identical to SEQ ID NO: 13023
  misc_feature 1..1656: note = derived and/or modified sequence opt1 from anti-influenza_Chain
  source 1..1656: mol_type = other RNA

SEQ ID NO: 13029 - RNA, 1656 nt, synthetic construct; identical to SEQ ID NO: 13024
  misc_feature 1..1656: note = derived and/or modified sequence opt1 from anti-influenza_Chain
  source 1..1656: mol_type = other RNA

SEQ ID NO: 13030 - RNA, 1680 nt, synthetic construct
  misc_feature 1..1680: note = derived and/or modified sequence opt1 from anti-influenza_Chain
  source 1..1680: mol_type = other RNA
atgagcaacatggacatcgactccatcaacaccggcaccatcgacaagacgcccgaggagctgaccccggggaccagcggcgccacccgccccatcatcaagcccgccacgctcgcgcccccgtccaacaagcggacccgcaaccccagccccgagcggaccaccacgtccagcgagaccgacatcgggcgcaagatccagaagaagcagacccccaccgagatcaagaagtccgtgtacaagatggtcgtgaagctgggcgagttctacaaccagatgatggtgaaggccgggctgaacgacgacatggagcggaacctcatccagaacgcccaggccgtcgagcgcatcctgctggccgcgacggacgacaagaagaccgagtaccagaagaagcggaacgcccgcgacgtgaaggagggcaaggaggagatcgaccacaacaagaccggcgggaccttctacaagatggtgcgggacgacaagacgatctacttcagcccgatcaagatcaccttcctcaaggaggaggtcaagaccatgtacaagaccacgatgggctccgacgggttcagcggcctgaaccacatcatgatcgggcactcccagatgaacgacgtgtgcttccagcgcagcaagggcctgaagcgggtgggcctcgacccctccctgatcagcaccttcgccgggtccaccctgccccgccggagcggcaccacgggggtcgccatcaagggcggcgggaccctcgtggacgaggcgatccgcttcatcggccgggccatggccgaccgcgggctgctgcgggacatcaaggccaagaccgcctacgagaagatcctcctgaacctgaagaacaagtgctccgcgccccagcagaaggccctcgtggaccaggtcatcggcagccgcaacccggggatcgccgacatcgaggacctgaccctgctcgcccggtccatggtggtggtccgccccagcgtggccagcaaggtggtcctgcccatctccatctacgcgaagatcccccagctgggcttcaacacggaggagtacagcatggtgggctacgaggccatggccctctacaacatggccaccccggtgtccatcctgcggatgggggacgacgccaaggacaagagccagctgttcttcatgtcctgcttcggcgcggcctacgaggacctccgcgtcctgagcgccctgaccgggaccgagttcaagccccgctccgccctcaagtgcaagggcttccacgtgcccgccaaggagcaggtcgaggggatgggcgcggccctgatgagcatcaagctgcagttctgggcccccatgacgcggtccggcgggaacgaggtgagcggcgagggcgggtccgggcagatcagctgctccccggtgttcgccgtcgagcgccccatcgcgctcagcaagcaggccgtgcggcgcatgctgtccatgaacgtggagggccgggacgccgacgtcaagggcaacctgctcaagatgatgaacgacagcatggccaagaagacctccgggaacgccttcatcggcaagaagatgttccagatcagcgacaagaacaaggtgaaccccatcgagatccccatcaagcagaccatcccgaacttcttcttcgggcgcgacaccgcggaggactacgacgacctggactac

SEQ ID NO: 13031 - RNA, 1680 nt, synthetic construct
  misc_feature 1..1680: note = derived and/or modified sequence opt1 from anti-influenza_Chain
  source 1..1680: mol_type = other RNA
atgaacacccagatcctggccctcatcgcctacatgctgatcggcgcgaagggggacaagatctgcctgggccaccacgccgtggccaacgggaccaaggtcaacacgctcaccgagcgcggcatcgaggtggtgaacgccaccgagaccgtcgagacggtgaacatcaagaagatctgcacccaggggaagcggcccaccgacctgggccagtgcggcctgctcgggaccctgatcggcccgccccagtgcgaccagttcctggagttcgacgccgacctcatcatcgagcgccgggaggggacggacgtgtgctaccccggcaagttcaccaacgaggagagcctgcgccagatcctgcgggggtccggcggcatcgacaaggagagcatggggttcacctactccggcatccgcaccaacggggtcacgagcgcgtgccggcgctccggcagctccttctacgccgagatgaagtggctcctgagcaactccgacaacgccgccttcccccagatgaccaagagctaccggaacccgcgcaacaagcccgcgctgatcatctggggcgtgcaccactccgggagcgccaccgagcagaccaagctctacggctccgggaacaagctgatcacggtgggcagctccaagtaccagcagagcttcaccccctcccccggggcccggccgcaggtcaacggccagagcggccgcatcgacttccactggctgctcctggaccccaacgacaccgtgaccttcacgttcaacggggccttcatcgcccccgaccgggcgtccttcttccgcggcgagagcctgggggtgcagagcgacgtccccctcgactccggctgcgagggggactgcttccacagccggggcaccatcgtgtccagcctgccgttccagaacatcaacccccgcaccgtgggcaagtgcccccggtacgtcaagcagacctccctgctcctggccacggggatgcgcaacgtgcccgagaacccgaagacccggggcctgttcggggccatcgccggcttcatcgagaacgggtgggagggcctcatcgacggctggtacgggttccgccaccagaacgcccagggcgaggggaccgcggccgactacaagagcacccagtccgccatcgaccagatcacgggcaagctgaaccggctgatcgacaagaccaaccagcagttcgagctcatcgacaacgagttcagcgagatcgagcagcagatcggcaacgtgatcaactggacccgcgactccatgaccgaggtctggagctacaacgccgagctgctggtggccatggagaaccagcacacgatcgacctcgcggactccgagatgaacaagctgtacgagcgcgtgcggaagcagctgcgcgagaacgccgaggaggacgggaccggctgcttcgagatcttccacaagtgcgacgaccagtgcatggagagcatccggaacaacacctacgaccacacccagtaccgcacggagtccctccagaaccggatccagatcgaccccgtcaagctgagctccgggtacaaggacatcatcctgtggttcagcttcggcgcctcctgcttcctcctgctggccatcgccatggggctcgtgttcatctgcatcaagaacggcaacatgcgctgcaccatctgcatc

SEQ ID NO: 13032 - RNA, 1680 nt, synthetic construct
  misc_feature 1..1680: note = derived and/or modified sequence opt1 from anti-influenza_Chain
  source 1..1680: mol_type = other RNA
atgaacacccagatcctggccctcatcgcctgcatgctgatcggcgcgaagggggacaagatctgcctgggccaccacgccgtggccaacgggaccaaggtcaacacgctcaccgagcgcggcatcgaggtggtgaacgccaccgagaccgtcgagacggccaacatcaagaagatctgcacccaggggaagcggcccaccgacctgggccagtgcggcctgctcgggaccctgatcggcccgccccagtgcgaccagttcctggagttcgacgcggacctcatcatcgagcgccgggaggggacggacgtgtgctaccccggcaagttcaccaacgaggagagcctgcgccagatcctgcgggggtccggcggcatcgacaaggagagcatggggttcacctactccggcatccgcaccaacggggccacgagcgcctgccggcgctccggcagctccttctacgccgagatgaagtggctcctgagcaactccgacaacgcggccttcccccagatgaccaagagctaccggaacccgcgcaacaagcccgccctgatcatctggggcgtgcaccactccgggagcgccaccgagcagaccaagctctacggctccgggaacaagctgatcacggtcggcagctccaagtaccagcagagcttcaccccctcccccggggcccggccccaggtgaacggccagagcggccgcatcgacttccactggctgctcctggacccgaacgacaccgtgaccttcacgttcaacggggcgttcatcgcccccgaccgggcctccttcttccgcggcgggagcctgggcgtccagagcgacgtgcccctcgactccgggtgcgagggcgactgcttccacagcggcgggaccatcgtgtccagcctgccgttccagaacatcaacccccggaccgtcggcaagtgcccccgctacgtgaagcagacctccctgctcctggccacggggatgcggaacgtgcccgagaacccgaagacccgcggcctgttcggggccatcgcgggcttcatcgagaacggctgggaggggctcatcgacggctggtacgggttccggcaccagaacgcccagggcgagggcaccgccgccgactacaagagcacccagtccgccatcgaccagatcacggggaagctgaaccgcctgatcgacaagaccaaccagcagttcgagctcatcgacaacgagttcaacgagatcgagcagcagatcggcaacgtcatcaactggacccgggacagcatgaccgaggtgtggtcctacaacgcggagctgctggtggccatggagaaccagcacacgatcgacctcgccgacagcgagatgaacaagctgtacgagcgcgtccgcaagcagctgcgggagaacgccgaggaggacgggaccggctgcttcgagatcttccacaagtgcgacgaccagtgcatggagtccatccgcaacaacacctacgaccacacccagtaccggacggagagcctccagaaccgcatccagatcaaccccgtgaagctgtccagcgggtacaaggacatcatcctgtggttctccttcggcgccagctgcttcctcctgctggcgatcgccatgggcctcgtgttcatctgcatcaagaacgggaacatgcggtgcaccatctgcatc

SEQ ID NO: 13033 - RNA, 1680 nt, synthetic construct
  misc_feature 1..1680: note = derived and/or modified sequence opt1 from anti-influenza_Chain
  source 1..1680: mol_type = other RNA
atggagcgcatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgggactgctccgtcgccgggtggctgctcggcaacccgatgtgcgacgagttcctgaacgtgcccgagtggagctacatcgtggagaagatcaaccccgccaacgacctgtgctaccccgggaacttcaacgactacgaggagctcaagcacctcctgtcccgcatcaaccacttcgagcggatccagatcatccccaagagctcctggagcgaccacgaggcctccagcggcgtctccagcgcctgcccgtaccagggccgctccagcttcttccggaacgtggtgtggctgatcaagaagaacaacgcgtaccccaccatcaagcgctcctacaacaacacgaaccaggaggacctgctggtcctctgggggatccaccaccccaacgacgccgccgagcagacccggctgtaccagaacccgaccacctacatcagcgtgggcacgtccaccctgaaccagcgcctcgtgcccaagatcgccacccggagcaaggtcaacgggcagtccggccgcatggagttcttctggaccatcctgaagcccaacgacgcgatcaacttcgagagcaacgggaacttcatcgcccccgagaacgcctacaagaactgccagaagggcgacagcacgatcatgaagtccgagctggagtacggcaactgcaacaccaagtgccagaccccgatcggggccatcaacagctccatgcccttccacaacatccaccccctcaccatcggcgagtgccccaagtacgtcaagagcaaccggctggtgctggccacggggctccgcaactccccgcagggcgagcggcgccggaagaagcgcggcctgttcggggcgatcgccggcttcatcgagggcgggtggcaggggatggtggacggctggtacggctaccaccacagcaacgagcaggggtccggctacgccgccgacaaggagagcacccagaaggccatcgacggggtgaccaacaaggtgaactccatcatcgacaagatgaacacccagttcgaggcggtcggccgggagttcaacaacctggagcgccggatcgagaacctcaacaagaagatggaggacgggttcctggacgtgtggacgtacaacgccgagctgctcgtgctgatggagaacgagcgcaccctggacttccacgacagcaacgtcaagaacctctacgacaaggtgcggctgcagctgcgcgacaacgccaaggagctcggcaacggctgcttcgagttctaccaccgctgcgacaacgagtgcatggagtccgtccggaacgggacctacgactacccccagtacagcgaggaggcccgcctgaagcgggaggagatctccggcgtgaagctggagagcatcgggacctaccagatcctctccatctacagcacggtggcctccagcctggcgctggccatcatggtcgccggcctctccctgtggatgtgcagcaacggg

SEQ ID NO: 13034 - RNA, 1680 nt, synthetic construct; identical to SEQ ID NO: 13030
  misc_feature 1..1680: note = derived and/or modified sequence opt1 from anti-influenza_Chain
  source 1..1680: mol_type = other RNA

SEQ ID NO: 13035 - RNA, 1680 nt, synthetic construct; identical to SEQ ID NO: 13031
  misc_feature 1..1680: note = derived and/or modified sequence opt1 from anti-influenza_Chain
  source 1..1680: mol_type = other RNA

SEQ ID NO: 13036 - RNA, 1680 nt, synthetic construct; identical to SEQ ID NO: 13032
  misc_feature 1..1680: note = derived and/or modified sequence opt1 from anti-influenza_Chain
  source 1..1680: mol_type = other RNA

SEQ ID NO: 13037 - RNA, 1680 nt, synthetic construct; identical to SEQ ID NO: 13033
  misc_feature 1..1680: note = derived and/or modified sequence opt1 from anti-influenza_Chain
  source 1..1680: mol_type = other RNA

SEQ ID NO: 13038 - RNA, 1686 nt, synthetic construct
  misc_feature 1..1686: note = derived and/or modified sequence opt1 from anti-influenza_Chain
  source 1..1686: mol_type = other RNA
atgccccgcgccctgcggcgcgtgccgggcagccgggtcatgctccgcgtgggggtggtcgtggccgtgctggcgctggtcgccgccctcgccaacctggccgtgccccggcccgcgcgcgccgccggcgggggctactggcacacctccgggcgggagatcctggacgccaacaacgtgcccgtccgcatcgcgggcatcaactggttcggcttcgagacctgcaactacgtggtgcacgggctctggagccgggactaccgctccatgctggaccagatcaagagcctgggctacaacacgatccggctcccgtactccgacgacatcctgaagcccgggaccatgcccaacagcatcaacttctaccagatgaaccaggacctgcagggcctcacctccctgcaggtcatggacaagatcgtggcctacgccgggcagatcggcctgcgcatcatcctcgaccggcaccgccccgactgcagcggccagtccgccctgtggtacaccagctccgtgagcgaggccacgtggatctccgacctgcaggcgctcgcccagcggtacaaggggaacccgaccgtcgtgggcttcgacctgcacaacgagccccacgaccccgcctgctgggggtgcggcgaccccagcatcgactggcgcctggccgccgagcgggcgggcaacgccgtgctctccgtcaacccgaacctgctgatcttcgtggagggggtgcagagctacaacggcgactcctactggtggggcgggaacctccagggggccggccagtaccccgtcgtgctgaacgtgcccaaccgcctggtctacagcgcccacgactacgccacctccgtgtacccccagacctggttcagcgacccgacgttccccaacaacatgcccggcatctggaacaagaactgggggtacctcttcaaccagaacatcgcgcccgtctggctgggcgagttcgggaccaccctgcagagcaccacggaccagacctggctcaagaccctggtgcagtacctgcggccgaccgcccagtacggcgccgactccttccagtggacgttctggagctggaaccccgactccggggacaccggcggcatcctcaaggacgactggcagaccgtggacaccgtcaaggacgggtacctggcccccatcaagagctccatcttcgaccccgtgggcgccagcgcgtccccgagctcccagcccagcccctccgtgagcccctccccgagcccctcccccagcgcctcccgcacgccgacccccacccccacccccacggccagcccgacccccaccctgacccccacggccacccccaccccgaccgcgtcccccacgcccagccccaccgccgccagcggggcccggtgcaccgcctcctaccaggtcaacagcgactggggcaacgggttcaccgtgacggtggcggtcaccaactccggcagcgtggccaccaagacctggaccgtgtcctggacgttcggcgggaaccagaccatcaccaacagctggaacgccgccgtcacccagaacggccagtccgtgacggcccgcaacatgagctacaacaacgtgatccagccggggcagaacaccaccttcggcttccaggcgtcctacaccggcagcaacgccgcccccacggtcgcctgcgccgcgtcc

SEQ ID NO: 13039 - RNA, 1686 nt, synthetic construct
  misc_feature 1..1686: note = derived and/or modified sequence opt1 from anti-influenza_Chain
  source 1..1686: mol_type = other RNA
atggagcgcgtgtggtggaaggaggccgtcgtgtaccagatctacccccggagcttctacgactccaacggcgacgggatcggcgacatccgcgggatcatcgccaagctggactacctcaaggagctgggcgtggacgtcgtgtggctgagcccggtgtacaagtcccccaacgacgacaacgggtacgacatcagcgactaccgggacatcatggacgagttcggcaccatggcggactggaagaccatgctcgaggagatgcacaagcgcggcatcaagctggtcatggacctggtggtgaaccacacgtccgacgagcacccctggttcatcgagagccggaagtccaaggacaacccctaccgcgactactacatctggcggccggggaagaacggcaaggagcccaacaactgggagagcgtcttctccgggagcgcctgggagtacgacgagatgaccggcgagtactacctccacctgttctccaagaagcagcccgacctgaactgggagaaccccaaggtgcgccgggaggtgtacgagatgatgaagttctggctcgacaagggggtcgacggcttccgcatggacgtgatcaacatgatcagcaaggtgccggagctgcccgacggcgagccccagtccgggaagaagtacgccagcggctcccggtactacatgaacgggccccgcgtccacgagttcctgcaggagatgaaccgggaggtgctcagcaagtacgacatcatgaccgtgggcgagaccccgggcgtcacgcccaaggaggggatcctgtacaccgacccctcccgccgggagctgaacatggtgttccagttcgagcacatggacctcgacagcggccccgggggcaagtgggacatccgcccgtggtccctggccgacctgaagaagaccatgaccaagtggcagaaggagctcgaggggaagggctggaacagcctgtacctgaacaaccacgaccagccccgggccgtgagccgcttcggcgacgacgggaagtaccgggtcgagtccgcgaagatgctcgccacgttcctgcacatgatgcagggcaccccctacatctaccagggggaggagatcggcatgaccaacgtgcgcttccccagcatcgaggactaccgggacatcgagaccctgaacatgtacaaggagcgcgtggaggagtacggggaggacccgcaggaggtcatggagaagatctactacaagggccgcgacaacgcccggacgcccatgcagtgggacgactccgagaacgccggcttcaccgcggggaccccctggatccccgtgaacccgaactacaaggagatcaacgtcaaggccgccctcgaggaccccaacagcgtgttccactactacaagaagctgatccagctgcgcaagcagcacgacatcatcgtgtacggcacctacgacctcatcctggaggacgacccctacatctaccggtacacgcgcaccctggggaacgagcagctcatcgtcatcaccaacttctccgagaagacccccgtgttccggctgccggaccacatcatctacaagacgaaggagctgctcatcagcaactacgacgtggacgaggccgaggagctgaaggagatccgcctgcggccctgggaggcccgcgtctacaagatccggctcccc

SEQ ID NO: 13040 - RNA, 1686 nt, synthetic construct; identical to SEQ ID NO: 13038
  misc_feature 1..1686: note = derived and/or modified sequence opt1 from anti-influenza_Chain
  source 1..1686: mol_type = other RNA

SEQ ID NO: 13041 - RNA, 1686 nt, synthetic construct; identical to SEQ ID NO: 13039
  misc_feature 1..1686: note = derived and/or modified sequence opt1 from anti-influenza_Chain
  source 1..1686: mol_type = other RNA

SEQ ID NO: 13042 - RNA, 1689 nt, synthetic construct
  misc_feature 1..1689: note = derived and/or modified sequence opt1 from anti-influenza_Chain
  source 1..1689: mol_type = other RNA
atggagaagatcgtgctgctgttcgccatcgtcagcctggtgaagtccgaccagatctgcatcggctaccacgccaacaacagcaccgagcaggtcgacaccatcatggagaagaacgtgacggtgacccacgcgcaggacatcctggagaagaagcacaacgggaagctctgcgacctggacggcgtgaagcccctgatcctccgcgactgctccgtcgccgggtggctgctgggcaacccgatgtgcgacgagttcatcaacgtgcccgagtggagctacatcgtggagaaggccaaccccgtcaacgacctctgctaccccggggacttcaacgactacgaggagctgaagcacctcctctcccggatcaaccacttcgagaagatccagatcatccccaagagctcctggagctcccacgaggccagcctgggcgtgtccagcgcctgcccgtaccagggcaagacctccttcttccgcaacgtggtctggctgatcaagaagaacagcacctaccccacgatcaagcggtcctacaacaacaccaaccaggaggacctcctggtgctgtgggggatccaccaccccaacgacgcggccgagcagaccaagctctaccagaacccgaccacgtacatcagcgtgggcacctccaccctgaaccagcgcctggtcccccggatcgccacccgcagcaaggtgaacgggcagtccggccggatggagttcttctggacgatcctcaagcccaacgacgccatcaacttcgagagcaacgggaacttcatcgcgcccgagtacgcctacaagatcgtgaagaagggcgacagcaccatcatgaagtccgagctggagtacggcaactgcaacaccaagtgccagaccccgatgggggccatcaacagctccatgcccttccacaacatccaccccctgacgatcggcgagtgccccaagtacgtcaagagcaaccgcctcgtgctggccaccgggctgcggaactccccgcagcgcgagacccggggcctcttcggcgccatcgcggggttcatcgagggcgggtggcagggcatggtggacgggtggtacggctaccaccacagcaacgagcagggctccgggtacgccgccgacaaggagagcacccagaaggccatcgacggcgtcacgaacaaggtgaactccatcatcgacaagatgaacacccagttcgaggccgtggggcgcgagttcaacaacctggagcggcgcatcgagaacctgaacaagaagatggaggacggcttcctcgacgtctggacctacaacgcggagctgctggtgctcatggagaacgagcggaccctggacttccacgacagcaacgtcaagaacctgtacgacaaggtgcgcctccagctgcgggacaacgccaaggagctggggaacggctgcttcgagttctaccacaagtgcgacaacgagtgcatggagtccgtgcgcaacggcacgtacgactacccccagtacagcgaggaggcccggctcaagcgcgaggagatctccggggtcaagctggagagcatcggcatctaccagatcctgtccatctacagcaccgtggcctccagcctcgccctggcgatcatggtggccgggctgtccctctggatgtgcagcaacggcagcctgcagtgccggatctgc

SEQ ID NO: 13043 - RNA, 1689 nt, synthetic construct; identical to SEQ ID NO: 13042
  misc_feature 1..1689: note = derived and/or modified sequence opt1 from anti-influenza_Chain
  source 1..1689: mol_type = other RNA

SEQ ID NO: 13044 - RNA, 1692 nt, synthetic construct
  misc_feature 1..1692: note = derived and/or modified sequence opt1 from anti-influenza_Chain
  source 1..1692: mol_type = other RNA
atggagaagatcgtgctcctgttcgccatcgtcagcctggtgaagtccgaccagatctgcatcggctaccacgccaacaacagcaccgagcaggtcgacaccatcatggagaagaacgtgacggtgacccacgcgcaggacatcctggagaagacccacaacgggaagctctgctccctgaacggcgtgaagcccctgatcctccgcgactgcagcgtcgccgggtggctgctgggcaacccgatgtgcgacgagttcctcaacgtgcccgagtggtcctacatcgtggagaaggacagccccatcaacgggctgtgctaccccggcgacttcaacgactacgaggagctgaagcacctcctgtccagcaccaaccacttcgagaagatccagatcatcccgcggtccagctggtccgaccacgacgccagctccggcgtcagctccgcctgcccctacaacgggcgcagctccttcttccggaacgtggtgtggctgatcaagaagaacaacgcctaccccacgatcaagcgcaactacaacaacaccaaccaggaggacctcctggtcctgtggggcatccaccaccccaacgacgcgaccgagcagaccaagctctaccagaacccgacgacctacgtgagcgtggggacctccaccctgaaccagcggagcgtccccgagatcgccacgcgccccaaggtgaacggccagagcgggcggatcgagttcttctggaccatcctgaagcccaacgacgccatcaacttcgagtccaacggcaacttcatcgccccggagtacgcgtacaagatcgccaagaagggcgacagcgccatcatgaagtccgggctcgagtacggcaactgcaacaccaagtgccagacccccatgggggccatcaacagctccatgcccttccacaacatccaccccctgacgatcggcgagtgcccgcgctacgtcaagagcgaccggctggtgctcgccaccggcctgcgcaacgtgccccagcgggagacccgcgggctgttcggcgcgatcgccgggttcatcgagggcgggtggcagggcatggtggacggctggtacgggtaccaccactccaacgagcagggcagcgggtacgccgccgacaaggagtccacccagaaggccatcgacggcatcacgaacaaggtcaacagcatcatcgacaagatgaacacccagttcgaggcggtggggaaggagttcaacaacctcgagcggcgcatcgagaacctgaacaagaagatggaggacggcttcctggacgtgtggacctacaacgccgagctcctggtcctgatggagaacgagcggaccctcgacttccacgactccaacgtgaagaacctgtacgacaaggtccgcctgcagctccgggacaacgccaaggagctgggcaacgggtgcttcgagttctaccacaagtgcgacgacgagtgcatggagagcgtgcgcaacggcacgtacgactacccccagtactccgaggaggcccggctgaaccgcgaggagatcagcggggtgaagctcgagtccatcggcacctaccagatcctgagcatctactccaccgtcgccagctccctggcgctcgccatcatggtggccgggctgagcttctggatgtgcagcaacggctccctgcagtgccggatctgcatc

SEQ ID NO: 13045 - RNA, 1692 nt, synthetic construct; identical to SEQ ID NO: 13044
  misc_feature 1..1692: note = derived and/or modified sequence opt1 from anti-influenza_Chain
  source 1..1692: mol_type = other RNA

SEQ ID NO: 13046 - RNA, 1695 nt, synthetic construct
  misc_feature 1..1695: note = derived and/or modified sequence opt1 from anti-influenza_Chain
  source 1..1695: mol_type = other RNA
atggagaagatcgtgctgctgttcgccatcgtcagcctggtgaagtccgaccagatctgcatcggctaccacgccaacaacagcaccgagcaggtcgacaccatcatggagaagaacgtgacggtgacccacgcgcaggacatcctggagaagaagcacaacgggaagctctgcgacctggacggcgtgaagcccctgatcctccgcgactgctccgtcgccgggtggctgctgggcaacccgatgtgcgacgagttcatcaacgtgcccgagtggagctacatcgtggagaaggccaaccccgtcaacgacctctgctaccccggggacttcaacgactacgaggagctgaagcacctcctctcccggatcaaccacttcgagaagatccagatcatccccaagagctcctggagctcccacgaggccagcctgggcgtgtccagcgcctgcccgtaccagggcaagtccagcttcttccgcaacgtggtctggctgatcaagaagaactccacctaccccaccatcaagcggagctacaacaacacgaaccaggaggacctcctggtgctgtgggggatccaccaccccaacgacgcggccgagcagaccaagctctaccagaacccgaccacctacatctccgtgggcacgagcaccctgaaccagcgcctggtcccccggatcgccacccgctccaaggtgaacgggcagagcggccggatggagttcttctggaccatcctcaagcccaacgacgccatcaacttcgagagcaacgggaacttcatcgcgcccgagtacgcctacaagatcgtgaagaagggcgactccacgatcatgaagtccgagctggagtacggcaactgcaacaccaagtgccagaccccgatgggggccatcaacagcagcatgcccttccacaacatccaccccctgaccatcggcgagtgccccaagtacgtcaagtccaaccgcctcgtgctggccacggggctgcggaacagcccgcagcgcgagcggcgccggaagaagcgcggcctcttcggcgccatcgcggggttcatcgagggcgggtggcagggcatggtggacgggtggtacggctaccaccactccaacgagcagggcagcgggtacgccgccgacaaggagtccacccagaaggccatcgacggcgtcaccaacaaggtgaacagcatcatcgacaagatgaacacccagttcgaggccgtggggcgggagttcaacaacctggagcgccggatcgagaacctgaacaagaagatggaggacggcttcctcgacgtctggacgtacaacgcggagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcgtgcggaacggcacctacgactacccccagtactccgaggaggcccgcctcaagcgcgaggagatcagcggggtcaagctggagtccatcggcatctaccagatcctgagcatctactccaccgtggccagctccctcgccctggcgatcatggtggccgggctgagcctctggatgtgcagcaacggctccctgcagtgccgg

SEQ ID NO: 13047 - RNA, 1695 nt, synthetic construct
  misc_feature 1..1695: note = derived and/or modified sequence opt1 from anti-influenza_Chain
  source 1..1695: mol_type = other RNA
atggagaagatcgtgctgctgttcgccatcgtcagcctggtgaagtccgaccagatctgcatcggctaccacgccaacaacagcaccgagcaggtcgacaccatcatggagaagaacgtgacggtgacccacgcgcaggacatcctggagaagacccacaacgggaagctctgcgacctggacggcgtgaagcccctgatcctccgcgactgctccgtcgccgggtggctgctgggcaacccgatgtgcgacgagttcatcaacgtgcccgagtggagctacatcgtggagaaggccaaccccgtcaacgacctctgctaccccggggacttcaacgactacgaggagctgaagcacctcctctcccggatcaaccacttcgagaagatccagatcatccccaagagctcctggagctcccacgaggccagcctgggcgtgtccagcgcctgcccgtaccagggcaagtccagcttcttccgcaacgtggtctggctgatcaagaagaactccacctaccccacgatcaagcggagctacaacaacaccaaccaggaggacctcctggtgctgtgggggatccaccaccccaacgacgcggccgagcagaccaagctctaccagaacccgaccacgtacatctccgtgggcaccagcaccctgaaccagcgcctggtcccccggatcgccacccgctccaaggtgaacgggcagagcggccggatggagttcttctggacgatcctcaagcccaacgacgccatcaacttcgagagcaacgggaacttcatcgcgcccgagtacgcctacaagatcgtgaagaagggcgactccaccatcatgaagtccgagctggagtacggcaactgcaacaccaagtgccagaccccgatgggggccatcaacagcagcatgcccttccacaacatccaccccctgacgatcggcgagtgccccaagtacgtcaagtccaaccgcctcgtgctggccaccgggctgcggaacagcccgcagcgcgagcggcgccggaagaagcgcggcctcttcggcgccatcgcggggttcatcgagggcgggtggcagggcatggtggacgggtggtacggctaccaccactccaacgagcagggcagcgggtacgccgccgacaaggagtccacccagaaggccatcgacggcgtcaccaacaaggtgaacagcatcatcgacaagatgaacacgcagttcgaggccgtggggcgggagttcaacaacctggagcgccggatcgagaacctgaacaagaagatggaggacggcttcctcgacgtctggacctacaacgcggagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcgtgcggaacggcacctacgactacccccagtactccgaggaggcccgcctcaagcgcgaggagatcagcggggtcaagctggagtccatcggcatctaccagatcctgagcatctactccacggtggccagctccctcgccctggcgatcatggtggccgggctgagcctctggatgtgcagcaacggctccctgcagtgccgg

SEQ ID NO: 13048 - RNA, 1695 nt, synthetic construct
  misc_feature 1..1695: note = derived and/or modified sequence opt1 from anti-influenza_Chain
  source 1..1695: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccgccaacgacctgtgctaccccgggaacttcaacgactacgaggagctgaagcacctcctgtcccggatcaaccacttcgagaagatccagatcatccccaagagctcctggagcgaccacgaggcctccagcggcgtctccagcgcgtgcccgtaccagggcaagtccagcttcttccgcaacgtggtgtggctgatcaagaagaactccagctaccccaccatcaagcggtcctacaacaacacgaaccaggaggacctcctggtcctgtgggggatccaccaccccaacgacgccgccgagcagacccgcctctaccagaacccgaccacctacatcagcgtgggcacgtccaccctgaaccagcggctggtgcccaagatcgccacccgcagcaaggtcaacgggcagagcggccggatggagttcttctggaccatcctcaagcccaacgacgcgatcaacttcgagtccaacgggaacttcatcgcccccgagtacgcctacaagatcgtgaagaagggcgacagcgccatcatgaagtccgagctggagtacggcaactgcaacacgaagtgccagaccccgatgggggccatcaacagctccatgcccttccacaacatccaccccctgaccatcggcgagtgccccaagtacgtcaagagcaaccgcctcgtgctggcgaccgggctgcggaactccccgcagcgcgagcggcgccggaagaagcgcggcctcttcggcgccatcgccgggttcatcgagggcgggtggcagggcatggtggacgggtggtacggctaccaccacagcaacgagcagggctccgggtacgccgccgacaaggagagcacgcagaaggcgatcgacggcgtgaccaacaaggtcaactccatcatcgacaagatgaacacccagttcgaggccgtggggcgggagttcaacaacctggagcgccggatcgagaacctgaacaagaagatggaggacggcttcctcgacgtgtggacctacaacgccgagctgctggtcctcatggagaacgagcgcacgctggacttccacgacagcaacgtgaagaacctgtacgacaaggtccggctccagctgcgcgacaacgccaaggagctggggaacggctgcttcgagttctaccacaagtgcgacaacgagtgcatggagtccgtgcggaacggcacctacgactacccccagtacagcgaggaggcccgcctcaagcgcgaggagatctccggggtgaagctggagagcatcggcatctaccagatcctgtccatctacagcaccgtcgcgtccagcctcgccctggccatcatggtggccgggctgagcctctggatgtgctccaacggcagcctgcagtgccgg

SEQ ID NO: 13049 - RNA, 1695 nt, synthetic construct
  misc_feature 1..1695: note = derived and/or modified sequence opt1 from anti-influenza_Chain
  source 1..1695: mol_type = other RNA
atgagcgaccgccggcagaaccgcaagacccccgacgagcagcggaaggccaacgccctgatcatcaacgagaacatcgaggcgtacatcgccatctgcaaggaggtgggcctcaacggggacgagatgctgatcctggagaacggcatcgccatcgagaaggccatccgcatctgctgcgacgggaagtaccaggagaagcgggagaagaaggcccgcgaggcgcagcgggccgactccaacttcaacgccgacagcatcggcatccgcctcgtcaagcgggccgggtccggcaccaacatcacgtaccacgcggtggtggagctgaccagccgctcccggatcgtccagatcctcaagagccactggggcaacgagctgaaccgcgccaagatcgccgggaagcggctgggcttctccgccctgttcgccagcaacctcgaggcgatcatctaccagcgcgggcggaacgccgcccgccggaacggctccgccgagctgttcaccctgacccagggggccggcatcgagacgcgctacaagtggatcatggagaagcacatcggcatcggggtgctcatcgcggacgccaagggcctgatcaacgggaagcgggagggcaagcgcggcgtggacgccaacgtcaagctgcgggccgggaccaccggcagcccgctcgagcgcgccatgcaggggatcgagaagaaggcgttccccggccccctgcgcgccctggcccggcgcgtggtgaaggccaactacaacgacgcccgggaggcgctcaacgtcatcgccgaggcctccctgctgctcaagccccagatcaccaacaagatgacgatgccgtggtgcatgtggctggccgcgcgcctgaccctcaaggacgagttcgccaacttctgcgcctacgccgggcggcgcgccttcgaggtgttcaacatcgcgatggagaagatcggcatctgcagcttccagggcaccatcatgaacgacgacgagatcgagtccatcgaggacaaggcccaggtgctgatgatggcctgcttcgggctggcctacgaggacttcagcctcgtctccgccatggtgagccaccccctgaagctgcggaaccgcatgaagatcggcaacttccgggtgggggagaaggtctccaccgtgctcagccccctgctgcgcttcacgcggtgggcggagttcgcccagcgcttcgccctccaggccaacacctcccgggagggcgcccagatcagcaacagcgcggtgttcgccgtcgagcgcaagatcaccaccgacgtgcagcgggtggaggagctgctgaacaaggtccaggcccacgaggacgagcccctccagacgctgtacaagaaggtgcgcgagcagatctccatcatcgggcggaacaagagcgagatcaaggagttcctgggctccagcatgtacgacctcaacgaccaggagaagcagaacccgatcaacttccgctccggcgcccaccccttcttcttcgagttcgaccccgactacaaccccatccgggtgaagcgcccgaagaagcccatcgcgaagcgcaacagcaacatctcccggctggaggaggaggggatggacgagaacagcgagatcggccaggccaagaagatgaagcccctggaccagctcacctccaccagctccaacatccccgggaagaac

SEQ ID NO: 13050 - RNA, 1695 nt, synthetic construct
  misc_feature 1..1695: note = derived and/or modified sequence opt1 from anti-influenza_Chain
  source 1..1695: mol_type = other RNA
atgaaggtgaagctgctcgtcctgctgtgcaccttcaccgccacgtacgccgacaccatctgcatcggctaccacgcgaacaacagcaccgacaccgtggacacggtgctcgagaagaacgtcaccgtgacccactccgtgaacctgctggagaacagccacaacgggaagctctgcctgctgaagggcatcgcgcccctccagctggggaactgctccgtcgccggctggatcctggggaacccggagtgcgagctcctgatcagcaaggagtcctggagctacatcgtggagaagcccaaccccgagaacgggacctgctaccccggccacttcgccgactacgaggagctgcgcgagcagctctccagcgtgtccagcttcgagcggttcgagatcttcccgaaggagtccagctggcccaaccacacggtcaccggggtgtccgccagctgctcccacaacggcgagagctccttctaccgcaacctgctgtggctcaccgggaagaacggcctgtaccccaacctgagcaagtcctacgccaacaacaaggagaaggaggtgctcgtcctgtggggcgtgcaccacccgcccaacatcggcgaccagaaggccctgtaccacaccgagaacgcctacgtgagcgtcgtgagctcccactacagccggaagttcacgcccgagatcgccaagcgccccaaggtgcgggaccaggagggccgcatcaactaccactggaccctcctggagcccggggacaccatcatcttcgaggcgaacggcaacctgatcgccccgcggtacgccttcaccctctcccgcgggttcggcagcggcatcatcaactccaacgcccccatggacaagtgcgacgccaagtgccagacgccccagggggcgatcaacagctccctgcccttccagaacgtccacccggtgaccatcggcgagtgccccaagtacgtgcggagcgccaagctgcgcatggtcaccgggctccggaacatcccctccatccagagccgcggcctgttcggggccatcgccggcttcatcgagggcgggtggaccggcatggtggacgggtggtacggctaccaccaccagaacgagcaggggtccggctacgccgcggaccagaagtccacgcagaacgccatcaacggcatcaccaacaaggtgaacagcgtcatcgagaagatgaacacccagttcaccgccgtggggaaggagttcaacaagctggagcggcgcatggagaacctcaacaagaaggtcgacgacggcttcatcgacatctggacgtacaacgccgagctgctggtgctcctggagaacgagcggaccctggacttccacgacagcaacgtgaagaacctctacgagaaggtcaagtcccagctgaagaacaacgccaaggagatcgggaacggctgcttcgagttctaccacaagtgcaacgacgagtgcatggagagcgtgaagaacgggacctacgactaccccaagtactccgaggagagcaagctgaaccgcgagaagatcgacggcgtgaagctcgagtccatgggcgtctaccagatcctggcgatctacagcaccgtggccagctccctggtgctcctggtcagcctgggggccatctccttctggatgtgcagcaacggctccctccagtgccggatctgcatc

SEQ ID NO: 13051 - RNA, 1695 nt, synthetic construct
  misc_feature 1..1695: note = derived and/or modified sequence opt1 from anti-influenza_Chain
  source 1..1695: mol_type = other RNA
atgaaggtgaagctgctcgtcctgctgtgcaccttcaccgccacgtacgccgacaccatctgcatcggctaccacgcgaacaacagcaccgacaccgtggacacggtgctcgagaagaacgtcaccgtgacccactccgtgaacctgctggagaacagccacaacgggaagctctgcctgctgaagggcatcgcgcccctccagctggggaactgctccgtcgccggctggatcctggggaacccggagtgcgagctcctgatcagcaaggagtcctggagctacatcgtggagaagcccaaccccgagaacgggacctgctaccccggccacttcgccgactacgaggagctgcgcgagcagctctccagcgtgtccagcttcgagcggttcgagatcttcccgaaggagtccagctggcccaaccacacggtcaccggggtgtccgccagctgctcccacaacggcgagagctccttctaccgcaacctgctgtggctcaccgggaagaacggcctgtaccccaacctgagcaagtcctacgccaacaacaaggagaaggaggtgctcgtcctgtggggcgtgcaccacccgcccaacatcggcgaccagaagaccctgtaccacacggagaacgcctacgtgagcgtcgtgagctcccactacagccggaagttcacccccgagatcgccaagcgccccaaggtgcgggaccaggagggccgcatcaactactactggaccctcctggagcccggggacaccatcatcttcgaggccaacggcaacctgatcgcgccgcggtacgccttcgccctctcccgcgggttcggcagcggcatcatcaactccaacgcccccatggacaagtgcgacgccaagtgccagacgccccagggggcgatcaacagctccctgcccttccagaacgtccacccggtgaccatcggcgagtgccccaagtacgtgcggagcgccaagctgcgcatggtcaccgggctccggaacatcccctccatccagagccgcggcctgttcggggccatcgccggcttcatcgagggcgggtggaccggcatggtggacgggtggtacggctaccaccaccagaacgagcaggggtccggctacgccgcggaccagaagtccacgcagaacgccatcaacggcatcaccaacaaggtgaacagcgtcatcgagaagatgaacacccagttcaccgccgtggggaaggagttcaacaagctggagcggcgcatggagaacctcaacaagaaggtcgacgacggcttcatcgacatctggacgtacaacgccgagctgctggtgctcctggagaacgagcggaccctggacttccacgacagcaacgtgaagaacctctacgagaaggtcaagtcccagctgaagaacaacgccaaggagatcgggaacggctgcttcgagttctaccacaagtgcaacgacgagtgcatggagagcgtgaagaacgggacctacgactaccccaagtactccgaggagagcaagctgaaccgcgagaagatcgacggcgtgaagctcgagtccatgggcgtctaccagatcctggcgatctacagcaccgtggccagctccctggtgctcctggtcagcctgggggccatctccttctggatgtgcagcaacggctccctccagtgccggatctgcatc

SEQ ID NO: 13052 - RNA, 1695 nt, synthetic construct
  misc_feature 1..1695: note = derived and/or modified sequence opt1 from anti-influenza_Chain
  source 1..1695: mol_type = other RNA
atgaaggtgaagctgctcgtcctgctgtgcaccttcaccgccacgtacgccgacaccatctgcatcggctaccacgcgaacaacagcaccgacaccgtggacacggtgctcgagaagaacgtcaccgtgacccactccgtgaacctgctggagaacagccacaacgggaagctctgcctgctgaagggcatcgcgcccctccagctggggaactgctccgtcgccggctggatcctggggaacccggagtgcgagctcctgatcagcaaggagtcctggagctacatcgtggagaagcccaaccccgagaacgggacctgctaccccggccacttcgccgactacgaggagctgcgcgagcagctctccagcgtgtccagcttcgagcggttcgagatcttcccgaaggagtccagctggcccaaccacacggtcaccggggtgtccgccagctgctcccacaacggcgagagctccttctaccgcaacctgctgtggctcaccgggaagaacggcctgtaccccaacctgagcaagtcctacgccaacaacaaggagaaggaggtgctcgtcctgtggggcgtgcaccacccgcccgacatcggcgaccagaagaccctgtaccacacggagaacgcctacgtgagcgtcgtgagctcccactacagccggaagttcacccccgagatcgccaagcgccccaaggtgcgggaccaggagggccgcatcaactactactggaccctcctggagcccggggacaccatcatcttcgaggccaacggcaacctgatcgcgccgcggtacgccttcgccctctcccgcgggttcggcagcggcatcatcaactccaacgcccccatggacaagtgcgacgccaagtgccagacgccccagggggcgatcaacagctccctgcccttccagaacgtccacccggtgaccatcggcgagtgccccaagtacgtgcggagcgccaagctgcgcatggtcaccgggctccggaacatcccctccatccagagccgcggcctgttcggggccatcgccggcttcatcgagggcgggtggaccggcatggtggacgggtggtacggctaccaccaccagaacgagcaggggtccggctacgccgcggaccagaagtccacgcagaacgccatcaacggcatcaccaacaaggtgaacagcgtcatcgagaagatgaacacccagttcaccgccgtggggaaggagttcaacaagctggagcggcgcatggagaacctcaacaagaaggtcgacgacggcttcatcgacatctggacgtacaacgccgagctgctggtgctcctggagaacgagcggaccctggacttccacgacagcaacgtgaagaacctctacgagaaggtcaagtcccagctgaagaacaacgccaaggagatcgggaacggctgcttcgagttctaccacaagtgcaacgacgagtgcatggagagcgtgaagaacgggacctacgactaccccaagtactccgaggagagcaagctgaaccgcgagaagatcgacggcgtgaagctcgagtccatgggcgtctaccagatcctggcgatctacagcaccgtggccagctccctggtgctcctggtcagcctgggggccatctccttctggatgtgcagcaacggctccctccagtgccggatctgcatc

SEQ ID NO: 13053 - RNA, 1695 nt, synthetic construct
  misc_feature 1..1695: note = derived and/or modified sequence opt1 from anti-influenza_Chain
  source 1..1695: mol_type = other RNA
atgaaggtgaagctgctcgtcctgctgtgcaccttcaccgccacgtacgccgacaccatctgcatcggctaccacgcgaacaacagcaccgacaccgtggacacggtgctcgagaagaacgtcaccgtgacccactccgtgaacctgctggagaacagccacaacgggaagctctgcctgctgaagggcatcgcgcccctccagctggggaactgctccgtcgccggctggatcctggggaacccggagtgcgagctcctgatcagcaaggagtcctggagctacatcgtggagaagcccaaccccgagaacgggacctgctaccccggccacttcgccgactacgaggagctgcgcgagcagctctccagcgtgtccagcttcgagcggttcgagatcttcccgaaggagtccagctggcccaaccacacggtcaccggggtgtccgccagctgctcccacaacggcgagagctccttctaccgcaacctgctgtggctcaccgggaagaacggcctgtaccccaacctgagcaagtcctacgccaacaacaaggagaaggaggtgctcgtcctgtggggcgtgcaccacccgcccaacatcggcgaccagaaggccctgtaccacaccgagaacgcctacgtgagcgtcgtgagctcccactacagccggaagttcacgcccgagatcgccaagcgccccaaggtgcgggaccaggagggccgcatcaactactactggaccctcctggagcccggggacaccatcatcttcgaggcgaacggcaacctgatcgccccgcggtacgccttcgccctctcccgcgggttcggcagcggcatcatcaactccaacgcccccatggacaagtgcgacgcgaagtgccagacgccccagggggccatcaacagctccctgcccttccagaacgtccacccggtgaccatcggcgagtgccccaagtacgtgcggagcgccaagctgcgcatggtcaccgggctccggaacatcccctccatccagagccgcggcctgttcggggccatcgccggcttcatcgagggcgggtggaccggcatggtggacgggtggtacggctaccaccaccagaacgagcaggggtccggctacgcggccgaccagaagtccacccagaacgccatcaacggcatcacgaacaaggtgaacagcgtcatcgagaagatgaacacccagttcaccgccgtggggaaggagttcaacaagctggagcggcgcatggagaacctcaacaagaaggtcgacgacggcttcatcgacatctggacctacaacgccgagctgctggtgctcctggagaacgagcggacgctggacttccacgacagcaacgtgaagaacctctacgagaaggtcaagtcccagctgaagaacaacgcgaaggagatcgggaacggctgcttcgagttctaccacaagtgcaacgacgagtgcatggagagcgtgaagaacgggacctacgactaccccaagtactccgaggagagcaagctgaaccgcgagaagatcgacggcgtgaagctcgagtccatgggcgtctaccagatcctggccatctacagcaccgtggccagctccctggtgctcctggtcagcctgggggccatctccttctggatgtgcagcaacggctccctccagtgccggatctgcatc

SEQ ID NO: 13054 - RNA, 1695 nt, synthetic construct
  misc_feature 1..1695: note = derived and/or modified sequence opt1 from anti-influenza_Chain
  source 1..1695: mol_type = other RNA
atgaaggccaagctgctcgtgctgctgtgcaccttcaccgccacgtacgcggacaccatctgcatcggctaccacgccaacaacagcaccgacaccgtcgacacggtgctcgagaagaacgtgaccgtcacccactccgtgaacctgctggaggacagccacaacgggaagctctgcctgctgaagggcatcgcgcccctccagctggggaactgctccgtggccggctggatcctggggaacccggagtgcgagctcctgatcagcaaggagtcctggagctacatcgtcgagacccccaaccccgagaacggcacgtgctaccccggctacttcgccgactacgaggagctgcgcgagcagctctccagcgtgtccagcttcgagcggttcgagatcttcccgaaggagtccagctggcccaaccacaccgtgaccggggtctccgccagctgctcccacaacggcaagagctccttctaccgcaacctgctgtggctcaccgggaagaacggcctgtaccccaacctgagcaagtcctacgtgaacaacaaggagaaggaggtgctcgtcctgtggggcgtgcaccacccgcccaacatcgggaaccagcgggccctgtaccacacggagaacgcctacgtgagcgtcgtgagctcccactacagccgccggttcacccccgagatcgccaagcgccccaaggtgcgggaccaggagggccgcatcaactactactggaccctcctggagcccggggacaccatcatcttcgaggcgaacggcaacctgatcgccccgtggtacgccttcgccctctcccgggggttcggcagcggcatcatcacgtccaacgcccccatggacgagtgcgacgcgaagtgccagacgccccagggggccatcaacagctccctgcccttccagaacgtccacccggtgaccatcggcgagtgccccaagtacgtgcgcagcgccaagctgcggatggtcaccgggctccgcaacatcccctccatccagagccggggcctgttcggggccatcgccggcttcatcgagggcgggtggaccggcatggtggacgggtggtacggctaccaccaccagaacgagcaggggtccggctacgcggccgaccagaagtccacccagaacgccatcaacggcatcaccaacaaggtgaacagcgtcatcgagaagatgaacacccagttcacggccgtggggaaggagttcaacaagctggagcgccggatggagaacctcaacaagaaggtcgacgacggcttcctggacatctggacctacaacgccgagctgctcgtgctgctggagaacgagcgcaccctcgacttccacgacagcaacgtgaagaacctgtacgagaaggtcaagtcccagctgaagaacaacgcgaaggagatcgggaacggctgcttcgagttctaccacaagtgcaacaacgagtgcatggagagcgtgaagaacgggacctacgactaccccaagtactccgaggagagcaagctcaaccgggagaagatcgacggcgtgaagctggagtccatgggcgtctaccagatcctggccatctacagcacggtggccagctccctcgtgctgctggtcagcctcggggccatctccttctggatgtgcagcaacggctccctgcagtgccgcatctgcatc

SEQ ID NO: 13055 - RNA, 1695 nt, synthetic construct
  misc_feature 1..1695: note = derived and/or modified sequence opt1 from anti-influenza_Chain
  source 1..1695: mol_type = other RNA
atgaaggtgaagctgctcgtcctgctgtgcaccttcaccgccacgtacgccgacaccatctgcatcggctaccacgcgaacaacagcaccgacaccgtggacacggtgctcgagaagaacgtcaccgtgacccactccgtgaacctgctggaggacagccacaacgggaagctctgcctgctgaagggcatcgcgcccctccagctggggaactgctccgtcgccggctggatcctggggaacccggagtgcgagctcctgatcagccgcgagtcctggagctacatcgtggagaagcccaaccccgagaacgggacctgctaccccggccacttcgccgactacgaggagctgcgggagcagctctccagcgtgtccagcttcgagcgcttcgagatcttcccgaaggagtccagctggcccaaccacacgaccaccggggtctccgccagctgctcccacaacggcgagagctccttctacaagaacctgctgtggctcaccgggaagaacggcctgtaccccaacctgagcaagtcctacgccaacaacaaggagaaggaggtgctcgtgctgtggggcgtccaccacccgcccaacatcggcgaccagcgggccctgtaccacaaggagaacgcctacgtgagcgtggtcagctcccactacagccgcaagttcacgcccgagatcgccaagcggcccaaggtgcgcgaccaggagggccggatcaactactactggaccctcctggagcccggggacaccatcatcttcgaggcgaacggcaacctgatcgccccgcgctacgccttcgccctctcccgggggttcggcagcggcatcatcaactccaacgcccccatggacgagtgcgacgcgaagtgccagacgccccagggggccatcaacagctccctgcccttccagaacgtgcacccggtcaccatcggcgagtgccccaagtacgtgcgcagcgccaagctgcggatggtgaccgggctccgcaacatcccctccatccagagccggggcctgttcggggccatcgccggcttcatcgagggcgggtggaccggcatggtcgacgggtggtacggctaccaccaccagaacgagcaggggtccggctacgcggccgaccagaagtccacccagaacgccatcaacggcatcacgaacaaggtgaacagcgtgatcgagaagatgaacacccagttcaccgccgtcgggaaggagttcaacaagctggagcgccggatggagaacctcaacaagaaggtggacgacggcttcatcgacatctggacctacaacgccgagctgctggtcctcctggagaacgagcgcacgctggacttccacgacagcaacgtgaagaacctctacgagaaggtgaagtcccagctgaagaacaacgcgaaggagatcgggaacggctgcttcgagttctaccacaagtgcaacgacgagtgcatggagagcgtcaagaacgggacctacgactaccccaagtactccgaggagagcaagctgaaccgggagaagatcgacggcgtgaagctcgagtccatgggcgtgtaccagatcctggccatctacagcaccgtcgccagctccctggtgctcctggtgagcctgggggccatctccttctggatgtgcagcaacggctccctccagtgccgcatctgcatc

SEQ ID NO: 13056 - RNA, 1677 nt, synthetic construct
  misc_feature 1..1677: note = derived and/or modified sequence opt1 from anti-influenza_Chain
  source 1..1677: mol_type = other RNA
gacaagatctgcatcggctaccagagcaccaactccaccgagacggtggacaccctgaccaagaccaacgtccccgtgacgcaggccaaggagctcctgcacaccgagcacaacgggatgctgtgcgccaccaacctcggccacccgctgatcctggacacgtgcaccatcgaggggctcatctacggcaaccccagctgcgacctgctgctcgggggccgcgagtggtcctacatcgtggagcggcccagcgcggtcaacggcatgtgctaccccgggaacgtggagaacctggaggagctgcgcctcctgttctccagcgcctccagctaccagcgggtgcagatcttcccggacaccatctggaacgtcacctactccggcaccagctccgcctgcagcaactccttctaccgcagcatgcggtggctgacgcagaaggacaacacctaccccgtgcaggacgcccagtacaccaacaaccgcgggaagtccatcctcttcatgtggggcatcaaccacccgcccaccgacacggtgcagaccaacctgtacacccggaccgacacgaccaccagcgtcaccacggaggacatcaaccgcgccttcaagcccgtgatcgggccccggcccctggtgaacggcctccagggccgcatcgactactactggtccgtcctgaagcccgggcagaccctgcgggtgcgcagcaacggcaacctcatcgcgccgtggtacgggcacatcctgtccggcgagagccacggccggatcctcaagagcgacctgaactccgggaactgcgtggtccagtgccagaccgagcgcggcgggctgaacaccacgctgcccttccacaacgtgagcaagtacgccttcggcaactgccccaagtacgtgggggtcaagtccctcaagctggccgtgggcatgcggaacgtgcccgcccgcagctcccggggcctgttcggggcgatcgccggcttcatcgagggcgggtggccggggctcgtcgccggctggtacggcttccagcacagcaacgaccagggggtgggcatggccgccgaccgcgactccacccagaaggcgatcgacaagatcaccagcaaggtgaacaacatcgtcgacaagatgaacaagcagtacgagatcatcgaccacgagttctccgagatcgagacccggctgaacatgatcaacaacaagatcgacgaccagatccaggacatctgggcctacaacgccgagctgctcgtgctgctggagaaccagaagacgctcgacgagcacgacgccaacgtcaacaacctgtacaacaaggtgaagcgcgccctggggagcaacgcgatggaggacggcaaggggtgcttcgagctctaccacaagtgcgacgaccggtgcatggagaccatccgcaacggcacctacaaccgcggcaagtacaaggaggagtcccggctggagcgccagaagatcgagggggtgaagctggagagcgagggcacctacaagtccgggcggctcgtcccccgcggcagccccggctccgggtacatccccgaggccccgcgggacggccaggcctacgtgcgcaaggacggggagtgggtgctgctgagcacgttcctcggcaagcccatccccaaccccctgctggggctcgactccaccggc

SEQ ID NO: 13057 - RNA, 1677 nt, synthetic construct; identical to SEQ ID NO: 13056
  misc_feature 1..1677: note = derived and/or modified sequence opt1 from anti-influenza_Chain
  source 1..1677: mol_type = other RNA

SEQ ID NO: 13058 - RNA, 1695 nt, synthetic construct; identical to SEQ ID NO: 13049
  misc_feature 1..1695: note = derived and/or modified sequence opt1 from anti-influenza_Chain
  source 1..1695: mol_type = other RNA

SEQ ID NO: 13059 - RNA, 1695 nt, synthetic construct; identical to SEQ ID NO: 13046
  misc_feature 1..1695: note = derived and/or modified sequence opt1 from anti-influenza_Chain
  source 1..1695: mol_type = other RNA

SEQ ID NO: 13060 - RNA, 1695 nt, synthetic construct; identical to SEQ ID NO: 13047
  misc_feature 1..1695: note = derived and/or modified sequence opt1 from anti-influenza_Chain
  source 1..1695: mol_type = other RNA

SEQ ID NO: 13061 - RNA, 1695 nt, synthetic construct; identical to SEQ ID NO: 13048
  misc_feature 1..1695: note = derived and/or modified sequence opt1 from anti-influenza_Chain
  source 1..1695: mol_type = other RNA

SEQ ID NO: 13062 - RNA, 1695 nt, synthetic construct; identical to SEQ ID NO: 13050
  misc_feature 1..1695: note = derived and/or modified sequence opt1 from anti-influenza_Chain
  source 1..1695: mol_type = other RNA

SEQ ID NO: 13063 - RNA, 1695 nt, synthetic construct; identical to SEQ ID NO: 13051
  misc_feature 1..1695: note = derived and/or modified sequence opt1 from anti-influenza_Chain
  source 1..1695: mol_type = other RNA

SEQ ID NO: 13064 - RNA, 1695 nt, synthetic construct; identical to SEQ ID NO: 13052
  misc_feature 1..1695: note = derived and/or modified sequence opt1 from anti-influenza_Chain
  source 1..1695: mol_type = other RNA

SEQ ID NO: 13065 - RNA, 1695 nt, synthetic construct; identical to SEQ ID NO: 13053
  misc_feature 1..1695: note = derived and/or modified sequence opt1 from anti-influenza_Chain
  source 1..1695: mol_type = other RNA

SEQ ID NO: 13066 - RNA, 1695 nt, synthetic construct; identical to SEQ ID NO: 13054
  misc_feature 1..1695: note = derived and/or modified sequence opt1 from anti-influenza_Chain
  source 1..1695: mol_type = other RNA

SEQ ID NO: 13067 - RNA, 1695 nt, synthetic construct; identical to SEQ ID NO: 13055
  misc_feature 1..1695: note = derived and/or modified sequence opt1 from anti-influenza_Chain
  source 1..1695: mol_type = other RNA

SEQ ID NO: 13068 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgttcgcccagaagctgcccggcaacgacaactccaccgcgacgctctgcctggggcaccacgccgtcccgaacggcaccatcgtgaagaccatcaccaacgaccagatcgaggtgacgaacgccaccgagctggtccagagctccagcaccgggggcatctgcgacagcccccaccagatcctcgacggggagaactgcaccctgatcgacgccctgctcggcgacccccagtgcgacggcttccagaacaagaagtgggacctgttcgtggagcgcagcaaggcctactccaactgctacccctacgacgtgccggactacgcgagcctgcggtccctcgtcgccagctccgggacgctggagttcaacaacgagagcttcaactggaccggcgtgacccagaacgggacctccagcgcctgcaagcgccggtccaacaacagcttcttctcccgcctgaactggctcacgcacctgaagttcaagtaccccgccctgaacgtgaccatgcccaacaacgagaagttcgacaagctctacatctggggcgtccaccaccccgggaccgacaacgaccagatcagcctgtacgcgcaggcctccggccggatcaccgtgagcacgaagcgcagccagcagaccgtgatcccgtccatcggcagccggccccgcatccgggacgtcccctcccgcatcagcatctactggaccatcgtgaagcccggggacatcctgctcatcaactccaccggcaacctgatcgccccgcgggggtacttcaagatccgcagcggcaagtccagcatcatgcggtccgacgcccccatcggcaagtgcaacagcgagtgcatcacgcccaacgggtccatccccaacgacaagccgttccagaacgtgaaccgcatcacctacggcgcctgcccccggtacgtcaagcagaacaccctgaagctcgcgaccgggatgcgcaacgtgcccgagaagcagacgcggggcatcttcggggccatcgccggcttcatcgagaacggctgggaggggatggtggacggctggtacgggttccgccaccagaacagcgagggcaccgggcaggccgccgacctgaagtccacccaggcggccatcaaccagatcaacggcaagctgaaccggctcatcggcaagaccaacgagaagttccaccagatcgagaaggagttcagcgaggtcgaggggcgcatccaggacctggagaagtacgtggaggacacgaagatcgacctgtggtcctacaacgccgagctcctggtggccctggagaaccagcacaccatcgacctcaccgacagcgagatgaacaagctgttcgagcggaccaagaagcagctgcgcgagaacgccgaggacatgggcaacgggtgcttcaagatctaccacaagtgcgacaacgcgtgcatcggctccatccgcaacgggacgtacgaccacgacgtctaccgggacgaggccctcaacaaccgcttccagatcaagggcgtggagctgaagtccggctacaaggactggatcctgtggatctccttcgccatcagctgcttcctcctgtgcgtggccctgctcgggttcatcatgtgggcctgccagaagggcaacatccggtgcaacatctgcatc

SEQ ID NO: 13069 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgtccgcccagaagttccccggcaacgacaacagcaccgcgacgctgtgcctcgggcaccacgccgtcccgaacggcaccatcgtgaagaccatcaccaacgaccagatcgaggtgacgaacgccaccgagctggtccagtccagctccaccggggagatctgcgacagcccccaccagatcctggacggcgagaactgcaccctcatcgacgccctgctgggggacccccagtgcgacggcttccagaacaagaagtgggacctcttcgtggagcgctccaaggcctacagcaactgctacccctacgacgtgccggactacgcgtccctgcggagcctggtcgcctccagcggcacgctcgagttcaacaacgagtccttcaactggaccggggtgacccagaacggcaccagctccgcctgcatccgccggagcaacaactccttcttcagccgcctgaactggctgacgcacctcaagttcaagtaccccgccctgaacgtgaccatgcccaacaacgaggagttcgacaagctgtacatctggggcgtccaccaccccgggaccgacaacgaccagatcttcctctacgcgcaggcctccgggcggatcaccgtgagcacgaagcgcagccagcagaccgtgatcccgaacatccggtcccgcccccgggtccgcaacatccccagccggatctccatctactggaccatcgtgaagcccggcgacatcctgctgatcaacagcaccggcaacctcatcgccccgcgcgggtacttcaagatccggtccggcaagagctccatcatgcgcagcgacgcccccatcgggaagtgcaactccgagtgcatcacgcccaacggcagcatccccaacgacaagccgttccagaacgtgaaccggatcacctacggcgcctgcccccgctacgtcaagcagaacaccctgaagctggcgaccgggatgcggaacgtgcccgagaagcagacgcgcggcatcttcggggccatcgccggcttcatcgagaacgggtgggagggcatggtggacggctggtacgggttccggcaccagaactccgagggcatcgggcaggccgccgacctcaagagcacccaggcggccatcgaccagatcaacggcaagctgaaccgcctgatcgggaagaccaacgagaagttccaccagatcgagaaggagttctccgaggtcgagggccggatccaggacctcgagaagtacgtggaggacaccaagatcgacctgtggagctacaacgccgagctgctcgtggccctggagaaccagcacacgatcgacctgaccgactccgagatgaacaagctgttcgagaagaccaagaagcagctccgcgagaacgccgaggacatgggcaacgggtgcttcaagatctaccacaagtgcgacaacgcgtgcatcggcagcatccgcaacgggacctacgaccacgacgtctaccgggacgaggccctgaacaaccgcttccagatcaagggcgtggagctcaagtccgggtacaaggactggatcctgtggatcagcttcgccatctcctgcttcctgctctgcgtggccctgctgggcttcatcatgtgggcctgccagaagggcaacatccggtgcaacatctgcatc

SEQ ID NO: 13070 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgttcgcccagaagctgcccggcaacgacaactccaccgcgacgctctgcctggggcaccacgccgtcccgaacggcaccatcgtgaagaccatcaccaacgaccagatcgaggtgacgaacgccaccgagctggtccagagctccagcaccggggagatctgcgacagcccccaccagatcctcgacggcgagaactgcaccctgatcgacgccctgctcggggacccccagtgcgacggcttccagaacaagaagtgggacctgttcgtggagcgcagcaaggcctactccaactgctacccctacgacgtgccggactacgcgagcctgcggtccctcgtcgccagctccggcacgctggagttcaagaacgagagcttcaactggaccggggtgacccagaacggcacctccagcgcctgcatccgccggtccaacaacagcttcttctcccgcctgaactggctcacgcacctgaagttcaagtaccccgccctgaacgtgaccatgcccaacaaggagaagttcgacaagctctacatctggggcgtccaccaccccgggaccgacaacgaccagatcttcctgtacgcgcaggccagcgggcggatcaccgtgtccacgaagcgcagccagcagaccgtgatcccgaacatcggcagccggctgcgcgtccgggacatcccctcccgcatcagcatctactggaccatcgtgaagcccggcgacatcctcctgatcaactccaccgggaacctgatcgcgccccggggctacttcaagatccgcagcgggaagtccagcatcatgcggtccgacgccccgatcggcaagtgcaacagcgagtgcatcacgcccaacggctccatccccaacgacaagcccttccagaacgtgaaccgcatcacctacggggcctgcccgcggtacgtcaagcagaacaccctcaagctggccaccggcatgcgcaacgtgcccgagaagcagacgcgggggatcttcggcgccatcgccgggttcatcgagaacggctgggagggcatggtggacgggtggtacggcttccgccaccagaacagcgaggggaccggccaggccgccgacctgaagtccacccaggcggccatcgaccagatcaacgggaagctcaaccggctgatcggcaagaccaacgagaagttccaccagatcgagaaggagttcagcgaggtcgagggccgcatccaggacctggagaagtacgtggaggacacgaagatcgacctctggtcctacaacgccgagctgctggtggccctcgagaaccagcacaccatcgacctgaccgacagcgagatgaacaagctgttcgagaagaccaagaagcagctccgggagaacgccgaggacatggggaacggctgcttcaagatctaccacaagtgcgacaacgcgtgcatcgggtccatccgcaacggcacgtacgaccacgacgtctaccgcgacgaggccctgaacaaccggttccagatcaagggggtggagctgaagtccggctacaaggactggatcctctggatctccttcgccatcagctgcttcctgctgtgcgtggccctcctgggcttcatcatgtgggcctgccagaaggggaacatccgctgcaacatctgcatc

SEQ ID NO: 13071 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgttcgcccagaagctgcccggcaacgacaactccaccgcgacgctctgcctggggcaccacgccgtcccgaacggcaccatcgtgaagaccatcaccaacgaccagatcgaggtgacgaacgccaccgagctggtccagagctccagcaccggggagatctgcgacagcccccaccagatcctcgacggcgagaactgcaccctgatcgacgccctgctcggggacccccagtgcgacggcttccagaacaagaagtgggacctgttcgtggagcgcagcaaggcctactccaagtgctacccctacgacgtgccggactacgcgagcctgcggtccctcgtcgccagctccggcacgctggagttcaacaacgagagcttcaactggaccggggtgacccagaacggcacctccagcgcctgcatccgccggtccaacaacagcttcttctcccgcctgaactggctcacgcacctgaagttcaagtaccccgccctgaacgtgaccatgcccaacaacgagaagttcgacaagctctacatctggggcgtccaccaccccgggaccgacaacgaccagatcttcctgtacgcgcaggccagcgggcggatcaccgtgtccacgaagcgcagccagcagaccgtgatcccgaacatcggcagccggccccgcgtccgggacatcccctcccgcatcagcatctactggaccatcgtgaagcccggcgacatcctgctcatcaactccaccgggaacctgatcgccccgcggggctacttcaagatccgcagcgggaagtccagcatcatgcggtccgacgcccccatcggcaagtgcaacagcgagtgcatcacgcccaacggctccatccccaacgacaagccgttccagaacgtgaaccgcatcacctacggggcctgcccccggtacgtcaagcagaacaccctgaagctcgcgaccggcatgcgcaacgtgcccgagaagcagacgcgggggatcttcggcgccatcgccgggttcatcgagaacggctgggagggcatggtggacgggtggtacggcttccgccaccagaacagcgaggggatcggccaggccgccgacctgaagtccacccaggcggccatcgaccagatcaacgggaagctgaaccggctcatcggcaagaccaacgagaagttccaccagatcgagaaggagttcagcgaggtcgagggccgcatccaggacctggagaagtacgtggaggacaccaagatcgacctgtggtcctacaacgccgagctcctggtggccctggagaaccagcacacgatcgacctcaccgacagcgagatgaacaagctgttcgagaagaccaagaagcagctgcgggagaacgccgaggacatggggaacggctgcttcaagatctaccacaagtgcgacaacgcgtgcatcgggtccatccgcaacggcacctacgaccacgacgtctaccgcgacgaggccctcaacaaccggttccagatcaagggggtggagctgaagtccggctacaaggactggatcctgtggatctccttcgccatcagctgcttcctcctgtgcgtggccctgctcggcttcatcatgtgggcctgccagaaggggaacatccgctgcaacatctgcatc

SEQ ID NO: 13072 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgttcgcccagaagctgcccggcaacgacaactccaccgcgacgctctgcctggggcaccacgccgtcccgaacggcaccatcgtgaagaccatcaccaacgaccagatcgaggtgacgaacgccaccgagctggtccagagctccagcaccggggagatctgcgacagcccccaccagatcctcgacggcgagaactgcaccctgatcgacgccctgctcggggacccccagtgcgacggcttccagaacaagaagtgggacctgttcgtggagcgcagcaaggcctactccaactgctacccctacgacgtgccggactacgcgagcctgcggtccctcgtcgccagctccggcacgctggagttcaacaacgagagcttcaactggaccggggtgacccagaacggcacctccagcgcctgcatccgccggtccaacaacagcttcttctcccgcctgaactggctcacgcacctgaagttcaagtaccccgccctgaacgtgaccatgcccaacaacgagaagttcgacaagctctacatctggggcgtccaccaccccgggaccgacaacgaccagatcttcctgtacgcgcaggccagcgggcggatcaccgtgtccacgaagcgcagccagcagaccgtgatcccgaacatcggcagccggccccgcgtccggaacatcccctcccgcatcagcatctactggaccatcgtgaagcccggcgacatcctgctcatcaactccaccgggaacctgatcgccccgcggggctacttcaagatccgcagcgggaagtccagcatcatgcggtccgacgcccccatcggcaagtgcaacagcgagtgcatcacgcccaacggctccatccccaacgacaagccgttccagaacgtgaaccgcatcacctacggggcctgcccccggtacgtcaagcagaacaccctgaagctcgcgaccggcatgcgcaacgtgcccgagaagcagacgcgggggatcttcggcgccatcgccgggttcatcgagaacggctgggagggcatggtggacgggtggtacggcttccgccaccagaacagcgaggggatcggccaggccgccgacctgaagtccacccaggcggccatcgaccagatcaacgggaagctgaaccggctcatcggcaagaccaacgagaagttccaccagatcgagaaggagttcagcgaggtcgagggccgcatccaggacctggagaagtacgtggaggacaccaagatcgacctgtggtcctacaacgccgagctcctggtggccctggagaaccagcacacgatcgacctcaccgacagcgagatgaacaagctgttcgagaagaccaagaagcagctgcgggagaacgccgaggacatggggaacggctgcttcaagatctaccacaagtgcgacaacgcgtgcatcgggtccatccgcaacggcacctacgaccacgacgtctaccgcgacgaggccctcaacaaccggttccagatcaagggggtggagctgaagtccggctacaaggactggatcctgtggatctccttcgccatcagctgcttcctcctgtgcgtggccctgctcggcttcatcatgtgggcctgccagaaggggaacatccgctgcaacatctgcatc

SEQ ID NO: 13073 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgttctcccagaagctgcccggcaacgacaacagcaccgccacgctctgcctggggcaccacgcggtcccgaacggcaccatcgtgaagaccatcaccaacgaccagatcgaggtgacgaacgccaccgagctggtccagtccagctccaccgggggcatctgcgacagcccccaccagatcctcgacggggagaactgcaccctgatcgacgccctgctcggcgacccccagtgcgacggcttccagaacaagaagtgggacctgttcgtggagcgctccaaggcctacagcaactgctacccctacgacgtgccggactacgcctccctgcggagcctcgtcgcgtccagcgggacgctggagttcaacaacgagtccttcaactgggccggcgtgacccagaacgggaccagctccgcctgcaagcgccggagcaacaagtccttcttcagccgcctgaactggctcacccacctgaagtacaagtaccccgccctgaacgtgacgatgcccaacaacgagaagttcgacaagctctacatctggggcgtccaccaccccgtgaccgactccgaccagatcagcctgtacgcgcaggccagcgggcggatcaccgtgtccaccaagcgcagccagcagacggtcatcccgaacatcggctaccggccccgcgtgcgggacatctccagccgcatctccatctactggaccatcgtgaagcccggcgacatcctgctcatcaacagcaccgggaacctgatcgcgccccggggctacttcaagatccgctccggcaagagctccatcatgcggagcgacgccccgatcgggaagtgcaactccgagtgcatcacccccaacggcagcatccccaacgacaagcccttccagaacgtcaaccgcatcacgtacggggcctgcccgcggtacgtgaagcagaacaccctgaagctcgccaccggcatgcgcaacgtgcccgagaagcagacccgggggatcttcggcgccatcgccgggttcatcgagaacggctgggagggcatggtcgacgggtggtacggcttccgccaccagaactccgaggggacgggccaggccgccgacctcaagagcacccaggcggccatcaaccagatcaacgggaagctgaaccggctgatcggcaagaccaacgagaagttccaccagatcgagaaggagttctccgaggtggagggccgcatccaggacctggagaagtacgtggaggacaccaagatcgacctgtggagctacaacgccgagctcctggtcgccctggagaaccagcacacgatcgacctcaccgactccgagatgaacaagctgttcgagcggaccaagaagcagctgcgcgagaacgccgaggacatggggaacggctgcttcaagatctaccacaagtgcgacaacgcgtgcatcgagagcatccgcaacgggacctacgaccacgacgtgtaccgggacgaggccctcaacaaccgcttccagatcaagggcgtggagctgaagtccgggtacaaggactggatcctgtggatcagcttcgccatcagctgcttcctcctgtgcgtcgccctgctcggcttcatcatgtgggcctgccagaagggcaacatccggtgcaacatctgcatc

SEQ ID NO: 13074 - RNA, 1698 nt, synthetic construct
  misc_feature 1..1698: note = derived and/or modified sequence opt1 from anti-influenza_Chain
  source 1..1698: mol_type = other RNA
atgaagaccatcatcgccctgagctacatcctctgcctggtgttcgcccagaagctgcccggcaacgacaactccaccgcgacgctctgcctggggcaccacgccgtcccgaacggcaccatcgtgaagaccatcaccaacgaccagatcgaggtgacgaacgccaccgagctggtccagagctccagcaccgggggcatctgcgacagcccccaccagatcctcgacggggagaactgcaccctgatcgacgccctgctcggcgacccccagtgcgacggcttccagaacaagaagtgggacctgttcgtggagcgcagcaaggcctactccaactgctacccctacgacgtgccggactacgcgagcctgcggtccctcgtcgccagctccgggacgctggagttcaacgacgagagcttcaactggaccggcgtgacccagaacgggacctccagctcctgcaagcgccggagcaacaactccttcttcagccgcctgaactggctcacgcacctgaagttcaagtaccccgccctgaacgtgaccatgcccaacaacgagaagttcgacaagctctacatctggggcgtccaccaccccgtgaccgacaacgaccagatcttcctgtacgcccaggcgtccgggcggatcaccgtgagcacgaagcgcagccagcagaccgtcatcccgaacatcggctcccggccccgcatccggaacatccccagccgcatctccatctactggaccatcgtgaagcccggcgacatcctgctcatcaacagcaccgggaacctgatcgccccgcggggctacttcaagatccgctccgggaagtcctccatcatgcggagcgacgcccccatcggcaagtgcaactccgagtgcatcacgcccaacggcagcatccccaacgacaagccgttccagaacgtgaaccgcatcacctacggggcctgcccccggtacgtcaagcagaacaccctgaagctcgccaccggcatgcgcaacgtgcccgagaagcagacgcgggggatcttcggcgcgatcgccgggttcatcgagaacggctgggagggcatggtggacgggtggtacggcttccgccaccagaactccgaggggatcggccaggccgccgacctcaagagcacccaggccgcgatcaaccagatcaacgggaagctgaaccggctgatcggcaagaccaacgagaagttccaccagatcgagaaggagttctccgaggtcgagggccgcatccaggacctggagaagtacgtggaggacaccaagatcgacctgtggagctacaacgccgagctcctggtggccctggagaaccagcacacgatcgacctcaccgactccgagatgaacaagctgttcgagcggaccaagaagcagctgcgcgagaacgccgaggacatggggaacggctgcttcaagatctaccacaagtgcgacaacgcctgcatcgggagcatccgcaacggcacctacgaccacgacgtctaccgggacgaggcgctcaacaaccgcttccagatcaagggggtggagctgaagtccggctacaaggactggatcctgtggatcagcttcgccatctcctgcttcctcctgtgcgtggccctgctcggcttcatcatgtgggcctgccagaaggggaacatccggtgcaacatctgcatc

SEQ ID NO: 13075 - RNA, 1698 nt, synthetic construct
  misc_feature 1..1698: note = derived and/or modified sequence opt1 from anti-influenza_Chain
  source 1..1698: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccaccaacgacctgtgctaccccgggtccttcaacgactacgaggagctgaagcacctcctgagccggatcaaccacttcgagaagatccagatcatcccgaagtccagctggtccgaccacgaggccagctccggcgtcagctccgcctgcccctacctgggcagcccctccttcttccgcaacgtggtgtggctcatcaagaagaacagcacgtaccccaccatcaagaagtcctacaacaacaccaaccaggaggacctgctggtcctctgggggatccaccacccgaacgacgcggccgagcagacccggctgtaccagaaccccacgacctacatcagcatcggcacctccaccctgaaccagcgcctcgtgcccaagatcgccacgcggagcaaggtgaacgggcagagcggccgcatggagttcttctgggccatcctgaagcccaacgacgcgatcaacttcgagtccaacgggaacttcatcgccccggagtacgcctacaagatcgtcaagaagggcgacagcgccatcatgaagtccgagctggagtacggcaactgcaacaccaagtgccagacccccatgggggccatcaacagctccatgcccttccacaacatccaccccctcaccatcggcgagtgcccgaagtacgtgaagtccaaccggctggtgctggcgacggggctccgcaacagcccccagcgggagagccgccggaagaagcgcggcctgttcggcgccatcgccgggttcatcgagggcgggtggcagggcatggtcgacgggtggtacggctaccaccactccaacgagcagggcagcgggtacgccgccgacaaggagtccacccagaaggcgatcggcgtgaccaacaaggtgaacagcatcatcgacaagatgaacacccagttcgaggccgtcgggcgggagttcaacaacctggagcgccggatcgagaacctcaacaagaagatggaggacggcttcctggacgtgtggacgtacaacgccgagctgctcgtgctgatggagaacgagcgcaccctggacttccacgactccaacgtcaagaacctctacgacaaggtgcggctgcagctgcgcgacaacgccaaggagctcgggaacggctgcttcgagttctaccacaagtgcgacaacgagtgcatggagagcatccggaacggcacctacaacccccagtactccgaggaggcccgcctgaagcgggaggagatcagcggggtcaagctggagtccatcggcacctaccagatcctcagcatctactccacggtggcgagcagcctggccctggccatcatgatcgccgggctctccctgtggatgtgcagcaacggctccctgcagtgccgcatctgcatc

SEQ ID NO: 13076 - RNA, 1698 nt, synthetic construct
  misc_feature 1..1698: note = derived and/or modified sequence opt1 from anti-influenza_Chain
  source 1..1698: mol_type = other RNA
atgaaggccatcctggtggtcctcctgtacaccttcgccaccgcgaacgccgacacgctgtgcatcggctaccacgccaacaacagcaccgacaccgtggacaccgtgctcgagaagaacgtcacggtgacccactccgtgaacctgctggaggacaagcacaacgggaagctctgcaagctgcgcggcgtcgcgcccctgcacctcgggaagtgcaacatcgccggctggatcctggggaacccggagtgcgagagcctgtccaccgccagctcctggagctacatcgtggagacctccagctccgacaacggcacgtgctaccccggcgacttcatcgactacgaggagctccgggagcagctgagctccgtgagctccttcgagcgcttcgagatcttccccaagaccagctcctggcccaaccacgacagcaacaagggggtcaccgccgcctgcccgcacgccggcgcgaagtccttctacaagaacctgatctggctcgtgaagaaggggaacagctaccccaagctgtccaagagctacatcaacgacaagggcaaggaggtgctggtcctctgggggatccaccaccccagcacctccgccgaccagcagagcctgtaccagaacgccgacgcctacgtgttcgtgggcacgtcccggtacagcaagaagttcaagcccgagatcgccatccgcccgaaggtccgggaccaggagggccgcatgaactactactggaccctggtggagcccggggacaagatcaccttcgaggcgaccggcaacctcgtggtcccccggtacgccttcgccatggagcgcaacgccgggtccggcatcatcatcagcgacacgcccgtgcacgactgcaacacgacctgccagaccccgaagggcgccatcaacacctccctgcccttccagaacatccaccccatcaccatcgggaagtgccccaagtacgtcaagagcaccaagctgcggctcgcgaccggcctgcgcaacgtgccgtccatccagagccgggggctgttcggcgccatcgccgggttcatcgagggcggctggacggggatggtggacggctggtacgggtaccaccaccagaacgagcagggctccgggtacgccgccgacctcaagagcacccagaacgcgatcgacgagatcaccaacaaggtgaactccgtcatcgagaagatgaacacccagttcacggccgtgggcaaggagttcaaccacctggagaagcgcatcgagaacctgaacaagaaggtcgacgacggcttcctcgacatctggacctacaacgccgagctgctggtgctcctggagaacgagcggaccctggactaccacgacagcaacgtgaagaacctctacgagaaggtccgctcccagctgaagaacaacgccaaggagatcgggaacggctgcttcgagttctaccacaagtgcgacaacacgtgcatggagagcgtgaagaacgggacctacgactaccccaagtactccgaggaggccaagctgaaccgggaggagatcgacggcgtgaagctcgagagcacccgcatctaccagatcctggcgatctactccaccgtcgccagcagcctggtgctcgtggtctccctgggggccatcagcttctggatgtgctccaacggcagcctgcagtgccggatctgcatc

SEQ ID NO: 13077 - RNA, 1698 nt, synthetic construct
  misc_feature 1..1698: note = derived and/or modified sequence opt1 from anti-influenza_Chain
  source 1..1698: mol_type = other RNA
atgaaggccatcctggtggtcctcctgtacaccttcgccaccgcgaacgccgacacgctgtgcatcggctaccacgccaacaacagcaccgacaccgtggacaccgtgctcgagaagaacgtcacggtgacccactccgtgaacctgctggaggacaagcacaacgggaagctctgcaagctgcgcggcgtcgcgcccctgcacctcgggaagtgcaacatcgccggctggatcctggggaacccggagtgcgagagcctgtccaccgccagctcctggagctacatcgtggagacctccagctccgacaacggcacgtgctaccccggcgacttcatcgactacgaggagctccgggagcagctgagctccgtgagctccttcgagcgcttcgagatcttccccaagaccagctcctggcccaaccacgacagcaacaagggggtcaccgccgcctgcccgcacgccggcgcgaagtccttctacaagaacctgatctggctcgtgaagaaggggaacagctaccccaagctgtccaagagctacatcaacgacaagggcaaggaggtgctggtcctctgggggatccaccacccgcccaccagcgccgaccagcagtccctgtaccagaacgccgacgcctacgtgttcgtgggcagctcccggtacagcaagaagttcaagcccgagatcgccatccgccccaaggtccgggaccaggagggccgcatgaactactactggacgctggtggagcccggggacaagatcaccttcgaggcgaccggcaacctcgtggtcccccggtacgccttcgccatggagcgcaacgccgggtccggcatcatcatcagcgacaccccggtgcacgactgcaacacgacctgccagacccccaagggcgccatcaacacctccctgcccttccagaacatccaccccatcacgatcgggaagtgcccgaagtacgtcaagagcaccaagctgcggctcgcgaccggcctgcgcaacatcccctccatccagagccgggggctgttcggcgccatcgccgggttcatcgagggcggctggaccgggatggtggacggctggtacgggtaccaccaccagaacgagcagggctccgggtacgccgccgacctcaagagcacgcagaacgcgatcgacgagatcaccaacaaggtgaactccgtgatcgagaagatgaacacccagttcaccgccgtcggcaaggagttcaaccacctggagaagcgcatcgagaacctgaacaagaaggtggacgacggcttcctcgacatctggacgtacaacgccgagctgctggtcctcctggagaacgagcggaccctggactaccacgacagcaacgtgaagaacctctacgagaaggtgcgctcccagctgaagaacaacgccaaggagatcgggaacggctgcttcgagttctaccacaagtgcgacaacacgtgcatggagagcgtcaagaacgggacctacgactaccccaagtactccgaggaggccaagctgaaccgggaggagatcgacggcgtgaagctcgagagcacccgcatctaccagatcctggcgatctactccaccgtggccagcagcctggtcctcgtggtgtccctgggggccatcagcttctggatgtgctccaacggcagcctgcagtgccggatctgcatc

SEQ ID NO: 13078 - RNA, 1698 nt, synthetic construct; identical to SEQ ID NO: 13075
  misc_feature 1..1698: note = derived and/or modified sequence opt1 from anti-influenza_Chain
  source 1..1698: mol_type = other RNA

SEQ ID NO: 13079 - RNA, 1698 nt, synthetic construct; identical to SEQ ID NO: 13068
  misc_feature 1..1698: note = derived and/or modified sequence opt1 from anti-influenza_Chain
  source 1..1698: mol_type = other RNA

SEQ ID NO: 13080 - RNA, 1698 nt, synthetic construct; identical to SEQ ID NO: 13076
  misc_feature 1..1698: note = derived and/or modified sequence opt1 from anti-influenza_Chain
  source 1..1698: mol_type = other RNA

SEQ ID NO: 13081 - RNA, 1698 nt, synthetic construct; identical to SEQ ID NO: 13077
  misc_feature 1..1698: note = derived and/or modified sequence opt1 from anti-influenza_Chain
  source 1..1698: mol_type = other RNA

SEQ ID NO: 13082 - RNA, 1698 nt, synthetic construct; identical to SEQ ID NO: 13069
  misc_feature 1..1698: note = derived and/or modified sequence opt1 from anti-influenza_Chain
  source 1..1698: mol_type = other RNA

SEQ ID NO: 13083 - RNA, 1698 nt, synthetic construct; identical to SEQ ID NO: 13070
  misc_feature 1..1698: note = derived and/or modified sequence opt1 from anti-influenza_Chain
  source 1..1698: mol_type = other RNA

SEQ ID NO: 13084 - RNA, 1698 nt, synthetic construct; identical to SEQ ID NO: 13071
  misc_feature 1..1698: note = derived and/or modified sequence opt1 from anti-influenza_Chain
  source 1..1698: mol_type = other RNA

SEQ ID NO: 13085 - RNA, 1698 nt, synthetic construct; identical to SEQ ID NO: 13072
  misc_feature 1..1698: note = derived and/or modified sequence opt1 from anti-influenza_Chain
  source 1..1698: mol_type = other RNA

SEQ ID NO: 13086 - RNA, 1698 nt, synthetic construct; identical to SEQ ID NO: 13073
  misc_feature 1..1698: note = derived and/or modified sequence opt1 from anti-influenza_Chain
  source 1..1698: mol_type = other RNA

SEQ ID NO: 13087 - RNA, 1698 nt, synthetic construct; identical to SEQ ID NO: 13074
  misc_feature 1..1698: note = derived and/or modified sequence opt1 from anti-influenza_Chain
  source 1..1698: mol_type = other RNA

SEQ ID NO: 13088 - RNA, 1683 nt, synthetic construct
  misc_feature 1..1683: note = derived and/or modified sequence opt1 from anti-influenza_Chain
  source 1..1683: mol_type = other RNA
atggagaagatcgtgctgctgttcgccatcgtcagcctggtgaagtccgaccagatctgcatcggctaccacgccaacaacagcaccgagcaggtcgacaccatcatggagaagaacgtgacggtgacccacgcgcaggacatcctggagaagacccacaacgggaagctctgcgacctggacggcgtgaagcccctgatcctccgcgactgctccgtcgccgggtggctgctgggcaacccgatgtgcgacgagttcatcaacgtgcccgagtggagctacatcgtggagaaggccaaccccgtcaacgacctctgctaccccggggacttcaacgactacgaggagctgaagcacctcctctcccggatcaaccacttcgagaagatccagatcatccccaagagctcctggagctcccacgaggccagcctgggcgtgtccagcgcctgcccgtaccagggcaagtccagcttcttccgcaacgtggtctggctgatcaagaagaactccacctaccccacgatcaagcggagctacaacaacaccaaccaggaggacctcctggtgctgtgggggatccaccaccccaacgacgcggccgagcagaccaagctctaccagaacccgaccacgtacatctccgtgggcaccagcaccctgaaccagcgcctggtcccccggatcgccacccgctccaaggtgaacgggcagagcggccggatggagttcttctggacgatcctcaagcccaacgacgccatcaacttcgagagcaacgggaacttcatcgcgcccgagtacgcctacaagatcgtgaagaagggcgactccaccatcatgaagtccgagctggagtacggcaactgcaacaccaagtgccagaccccgatgggggccatcaacagcagcatgcccttccacaacatccaccccctgacgatcggcgagtgccccaagtacgtcaagtccaaccgcctcgtgctggccaccgggctgcggaacagcccgcagcgcgagcggcgccggaagaagcgcggcctcttcggcgccatcgcggggttcatcgagggcgggtggcagggcatggtggacgggtggtacggctaccaccactccaacgagcagggcagcgggtacgccgccgacaaggagtccacccagaaggccatcgacggcgtcaccaacaaggtgaacagcatcatcgacaagatgaacacgcagttcgaggccgtggggcgggagttcaacaacctggagcgccggatcgagaacctgaacaagaagatggaggacggcttcctcgacgtctggacctacaacgcggagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcgtgcggaacggcacctacgactacccccagtactccgaggaggcccgcctcaagcgcgaggagatcagcggggtcaagctggagtccatcggcatctaccagatccagcacagcgggggccggtccagcctggaggggccccgcttcgagcagaagctcatctccgaggaggacctgaacatgcacacgggc

SEQ ID NO: 13089 - RNA, 1683 nt, synthetic construct
  misc_feature 1..1683: note = derived and/or modified sequence opt1 from anti-influenza_Chain
  source 1..1683: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccgccaacgacctgtgctaccccgggaacttcaacgactacgaggagctgaagcacctcctgtcccggatcaaccacttcgagaagatccagatcatccccaagagctcctggagcgaccacgaggcctccagcggcgtctccagcgcgtgcccgtaccagggcaagtccagcttcttccgcaacgtggtgtggctgatcaagaagaactccagctaccccaccatcaagcggtcctacaacaacacgaaccaggaggacctcctggtcctgtgggggatccaccaccccaacgacgccgccgagcagacccgcctctaccagaacccgaccacctacatcagcgtgggcacgtccaccctgaaccagcggctggtgcccaagatcgccacccgcagcaaggtcaacgggcagagcggccggatggagttcttctggaccatcctcaagcccaacgacgcgatcaacttcgagtccaacgggaacttcatcgcccccgagtacgcctacaagatcgtgaagaagggcgacagcgccatcatgaagtccgagctggagtacggcaactgcaacacgaagtgccagaccccgatgggggccatcaacagctccatgcccttccacaacatccaccccctgaccatcggcgagtgccccaagtacgtcaagagcaaccgcctcgtgctggcgaccgggctgcggaactccccgcagcgcgagcggcgccggaagaagcgcggcctcttcggcgccatcgccgggttcatcgagggcgggtggcagggcatggtggacgggtggtacggctaccaccacagcaacgagcagggctccgggtacgccgccgacaaggagagcacgcagaaggcgatcgacggcgtgaccaacaaggtcaactccatcatcgacaagatgaacacccagttcgaggccgtggggcgggagttcaacaacctggagcgccggatcgagaacctgaacaagaagatggaggacggcttcctcgacgtgtggacctacaacgccgagctgctggtcctcatggagaacgagcgcacgctggacttccacgacagcaacgtgaagaacctgtacgacaaggtccggctccagctgcgcgacaacgccaaggagctggggaacggctgcttcgagttctaccacaagtgcgacaacgagtgcatggagtccgtgcggaacggcacctacgactacccccagtacagcgaggaggcccgcctcaagcgcgaggagatctccggggtgaagctggagagcatcggcatctaccagatccagcactccgggggccggagctccctggaggggccccgcttcgagcagaagctcatcagcgaggaggacctgaacatgcacaccggc

SEQ ID NO: 13090 - RNA, 1701 nt, synthetic construct
  misc_feature 1..1701: note = derived and/or modified sequence opt1 from anti-influenza_Chain
  source 1..1701: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccgccaacgacctgtgctaccccgggaacttcaacgactacgaggagctgaagcacctcctgtcccggatcaaccacttcgagaagatccagatcatcagcaagtccagctggtccgaccacgaggccagctccggcgtcagctccgcgtgcccgtaccagggcacccccagcttcttccgcaacgtggtgtggctgatcaagaagaacaacacgtaccccaccatcaagcggtcctacaacaacaccaaccaggaggacctcctgatcctgtgggggatccaccacagcaacaacgccgccgagcagaccaagctctaccagaaccccacgacctacatctccgtcggcaccagcaccctgaacctgcgcctcgtgccgaagatcgccacgcggtccaaggtgaacgggcagagcggccgcatggacttcttctggaccatcctgaagcccaacgacgcgatcaacttcgagagcaacgggaacttcatcgcccccgagtacgcctacaagatcgtcaagaagggcgactccgccatcatgaagtccgaggtggagtacggcaactgcaacaccaagtgccagacccccatcggggccatcaacagcagcatgccgttccacaacatccaccccctgacgatcggcgagtgccccaagtacgtgaagtccaacaagctcgtcctggcgaccgggctgcggaacagccccctccgcgagcggcgccggaagcgcggcctgttcggcgccatcgccgggttcatcgagggcgggtggcagggcatggtggacgggtggtacggctaccaccactccaacgagcagggcagcgggtacgccgccgacaaggagtccacccagaaggcgatcgacggcgtgaccaacaaggtcaacagcatcatcgacaagatgaacacgcagttcgaggccgtggggcgggagttcaacaacctggagcgccggatcgagaacctcaacaagaagatggaggacggcttcctggacgtgtggacctacaacgccgagctgctcgtcctgatggagaacgagcgcaccctggacttccacgactccaacgtgaagaacctctacgacaaggtccggctgcagctgcgcgacaacgccaaggagctcgggaacggctgcttcgagttctaccacaagtgcgacaacgagtgcatggagagcgtgcggaacggcacctacgactacccgcagtactccgaggaggcccgcctgaagcgggaggagatcagcggggtgaagctggagtccatcggcacgtaccagatcctcagcatctactccaccgtcgcgagctccctggccctggccatcatggtggccgggctcagcctgtggatgtgcagcaacggctccctgcagtgccgcatctgcatc

SEQ ID NO: 13091 - RNA, 1701 nt, synthetic construct
  misc_feature 1..1701: note = derived and/or modified sequence opt1 from anti-influenza_Chain
  source 1..1701: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccgccaacgacctgtgctaccccgggaacttcaacgactacgaggagctgaagcacctcctgtcccggatcaaccacttcgagaagatccagatcatccccaagagctcctggagcgaccacgaggcctccagcggcgtctccagcgcgtgcccgtaccagggcaccccctccttcttccgcaacgtggtgtggctgatcaagaagaacaacacgtaccccaccatcaagcggagctacaacaacaccaaccaggaggacctcctgatcctgtgggggatccaccactccaacgacgccgccgagcagaccaagctctaccagaacccgacgacctacatcagcgtcggcacctccaccctgaaccagcgcctggtgcccaagatcgccacgcggagcaaggtgaacgggcagtccggccgcatggacttcttctggaccatcctcaagcccaacgacgcgatcaacttcgagagcaacgggaacttcatcgcccccgagtacgcctacaagatcgtcaagaagggcgacagcgccatcgtgaagtccgaggtggagtacggcaactgcaacaccaagtgccagaccccgatcggggccatcaacagctccatgcccttccacaacatccaccccctgacgatcggcgagtgccccaagtacgtcaagagcaacaagctggtgctcgcgaccgggctgcggaactccccgctgcgcgagcggcgccggaagcgcggcctcttcggcgccatcgccgggttcatcgagggcgggtggcagggcatggtggacgggtggtacggctaccaccacagcaacgagcagggctccgggtacgccgccgacaaggagagcacccagaaggcgatcgacggcgtcaccaacaaggtgaactccatcatcgacaagatgaacacgcagttcgaggccgtggggcgggagttcaacaacctggagcgccggatcgagaacctgaacaagaagatggaggacggcttcctcgacgtctggacctacaacgccgagctgctggtgctcatggagaacgagcgcaccctggacttccacgacagcaacgtcaagaacctgtacgacaaggtgcggctccagctgcgcgacaacgccaaggagctggggaacggctgcttcgagttctaccacaagtgcgacaacgagtgcatggagtccgtgcggaacggcacctacgactacccccagtacagcgaggaggcccgcctcaagcgggaggagatctccggggtcaagctggagagcatcggcacgtaccagatcctgtccatctacagcaccgtggcgtccagcctcgccctggccatcatggtggccgggctgtccctctggatgtgcagcaacggcagcctgcagtgccgcatctgcatc

SEQ ID NO: 13092 - RNA, 1683 nt, synthetic construct
  misc_feature 1..1683: note = derived and/or modified sequence opt1 from anti-influenza_Chain
  source 1..1683: mol_type = other RNA
gacaagatctgcctgggccaccacgccgtgagcaacgggaccaaggtcaacaccctcacggagcgcggcgtggaggtggtcaacgccaccgagaccgtggagcggaccaacgtgccccgcatctgctccaaggggaagcggacggtcgacctgggccagtgcgggctgctcggcaccatcaccggcccgccccagtgcgaccagttcctggagttcagcgccgacctgatcatcgagcgccgggaggggtccgacgtgtgctaccccggcaagttcgtgaacgaggaggccctccgccagatcctgcgggagagcgggggcatcgacaaggagaccatggggttcacgtactccggcatccgcaccaacggcaccaccagcgcctgccggcgctccgggagctccttctacgccgagatgaagtggctgctcagcaacacggacaacgccgcgttcccccagatgaccaagtcctacaagaacacccggaaggacccggccctgatcatctggggcatccaccacagcgggtccaccacggagcagaccaagctgtacggcagcggcaacaagctcatcaccgtcgggtccagcaactaccagcagtccttcgtgcccagccccggcgcccgcccccaggtgaacgggcagtccggccggatcgacttccactggctgatcctgaacccgaacgacaccgtcacgttcagcttcaacggggccttcatcgcgcccgaccgcgccagcttcctccggggcaagtccatgggcatccagagcgaggtccaggtggacgccaactgcgagggggactgctaccactccggcgggaccatcatcagcaacctgcccttccagaacatcaactcccgcgccgtgggcaagtgcccccggtacgtgaagcaggagagcctgctcctggccaccgggatgaagaacgtgccggagatccccaagcgccggcgccggggcctgttcggcgcgatcgccgggttcatcgagaacggctgggaggggctcatcgacggctggtacgggttccgccaccagaacgcccagggcgagggcaccgccgccgactacaagtccacgcagagcgcgatcgaccagatcaccgggaagctgaaccgcctgatcgagaagaccaaccagcagttcgagctcatcgacaacgagttcaccgaggtcgagcggcagatcggcaacgtgatcaactggacgcgcgactccatgaccgaggtgtggagctacaacgccgagctgctggtcgccatggagaaccagcacaccatcgacctcgccgactccgagatgaacaagctgtacgagcgggtgaagcgccagctgcgggagaacgccgaggaggacgggaccggctgcttcgagatcttccacaagtgcgacgacgactgcatggcgagcatccgcaacaacacgtacgaccactccaagtaccgggaggaggccatccagaaccgcatccagatcgaccccgtgaagctcagctccggctacaaggacagcgggcggctggtcccccgcggctccccggggagcggctacatccccgaggcgccccgggacgggcaggcctacgtgcgcaaggacggcgagtgggtcctgctctccaccttcctgggcaagcccatcccgaaccccctgctcgggctggacagcaccggc

SEQ ID NO: 13093 - RNA, 1701 nt, synthetic construct
  misc_feature 1..1701: note = derived and/or modified sequence opt1 from anti-influenza_Chain
  source 1..1701: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccgccaacgacctgtgctaccccgggaacttcaacgactacgaggagctgaagcacctcctgtcccggatcaaccacttcgagaagatccagatcatccccaagagctcctggagcgaccacgaggcctccagcggcgtctccagcgcgtgcccgtaccagggcaccccctccttcttccgcaacgtggtgtggctgatcaagaagaacaacacgtaccccaccatcaagcggagctacaacaacaccaaccaggaggacctcctgatcctgtgggggatccaccactccaacgacgccgccgagcagaccaagctctaccagaacccgacgacctacatcagcgtcggcacctccaccctgaaccagcgcctggtgcccaagatcgccacgcggagcaaggtgaacgggcagaacggccgcatggacttcttctggaccatcctcaagcccaacgacgcgatcaacttcgagtccaacgggaacttcatcgcccccgagtacgcctacaagatcgtcaagaagggcgacagcgccatcgtcaagagcgaggtggagtacggcaactgcaacaccaagtgccagaccccgatcggggccatcaactccagcatgcccttccacaacatccaccccctgacgatcggcgagtgccccaagtacgtgaagtccaacaagctggtgctcgcgaccgggctgcggaacagcccgctgcgcgagcggcgccggaagcgcggcctcttcggcgccatcgccgggttcatcgagggcgggtggcagggcatggtggacgggtggtacggctaccaccactccaacgagcagggcagcgggtacgccgccgacaaggagtccacccagaaggcgatcgacggcgtcaccaacaaggtgaacagcatcatcgacaagatgaacacgcagttcgaggccgtggggcgggagttcaacaacctggagcgccggatcgagaacctgaacaagaagatggaggacggcttcctcgacgtctggacctacaacgccgagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcgtgcggaacggcacctacgactacccccagtactccgaggaggcccgcctcaagcgggaggagatcagcggggtcaagctggagtccatcggcacgtaccagatcctgagcatctactccaccgtggcgagctccctcgccctggccatcatggtggccgggctgagcctctggatgtgctccaacggcagcctgcagtgccgcatctgcatc

SEQ ID NO: 13094 - RNA, 1683 nt, synthetic construct; identical to SEQ ID NO: 13092
  misc_feature 1..1683: note = derived and/or modified sequence opt1 from anti-influenza_Chain
  source 1..1683: mol_type = other RNA

SEQ ID NO: 13095 - RNA, 1683 nt, synthetic construct; identical to SEQ ID NO: 13088
  misc_feature 1..1683: note = derived and/or modified sequence opt1 from anti-influenza_Chain
  source 1..1683: mol_type = other RNA

SEQ ID NO: 13096 - RNA, 1683 nt, synthetic construct; identical to SEQ ID NO: 13089
  misc_feature 1..1683: note = derived and/or modified sequence opt1 from anti-influenza_Chain
  source 1..1683: mol_type = other RNA

SEQ ID NO: 13097 - RNA, 1701 nt, synthetic construct; identical to SEQ ID NO: 13093
  misc_feature 1..1701: note = derived and/or modified sequence opt1 from anti-influenza_Chain
  source 1..1701: mol_type = other RNA

SEQ ID NO: 13098 - RNA, 1701 nt, synthetic construct; identical to SEQ ID NO: 13090
  misc_feature 1..1701: note = derived and/or modified sequence opt1 from anti-influenza_Chain
  source 1..1701: mol_type = other RNA

SEQ ID NO: 13099 - RNA, 1701 nt, synthetic construct; identical to SEQ ID NO: 13091
  misc_feature 1..1701: note = derived and/or modified sequence opt1 from anti-influenza_Chain
  source 1..1701: mol_type = other RNA

SEQ ID NO: 13100 - RNA, 1704 nt, synthetic construct
  misc_feature 1..1704: note = derived and/or modified sequence opt1 from anti-influenza_Chain
  source 1..1704: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcctgaacgtgcccgagtggagctacatcgtggagaagatcaaccccgccaacgacctgtgctaccccggggacttcaacgactacgaggagctcaagcacctcctgtcccggatcaaccacttcgagaagatccagatcatccccaagagctcctggagcgactacgaggcctccagcggcgtctccagcgcctgcccgtaccagggccgctccagcttcttccggaacgtggtgtggctgatcaagaagaacaacgcgtaccccaccatcaagcgctcctacaacaacacgaaccaggaggacctgctggtcctctgggggatccaccaccccaacgacgccgccgagcagatccggctgtaccagaacccgaccacctacatcagcatcggcacctccacgctgaaccagcgcctcgtgcccaagatcgccacccggagcaaggtgaacgggcagtccggccgcatggagttcttctggaccatcctcaagagcaacgacgcgatcaacttcgagagcaacgggaacttcatcgcccccgagtacgcctacaagatcgtcaagaagggcgactccaccatcatgaagtccgagctggagtacggcaactgcaacacgaagtgccagacccccatcggggccatcaacagcagcatgccgttccacaacatccaccccctgaccatcggcgagtgccccaagtacgtgaagtccaaccggctggtgctggccaccgggctccgcaacagcccccagggcgagcggcgccggcgcaagcggggcctgttcggggcgatcgccggcttcatcgagggcgggtggcaggggatggtcgacggctggtacggctaccaccactccaacgagcaggggagcggctacgccgccgacaaggagtccacgcagaaggccatcgacggggtgaccaacaaggtgaacagcatcatcaacaagatgaacacccagttcgaggcggtcggccgcgagttcaacaacctggagcggcgcatcgagaacctcaacaagaagatggaggacgggttcctggacgtgtggacctacaacgccgagctgctcgtgctgatggagaacgagcggacgctggacttccacgactccaacgtcaagaacctctacgacaaggtgcgcctgcagctgcgggacaacgccaaggagctcggcaacggctgcttcgagttctaccaccgctgcgacaacgagtgcatggagagcgtccgcaacgggacctacgactacccgcagtactccgaggaggcccggctgaagcgcgaggagatcagcggcgtgaagctggagtccatggggatctaccagatcctcagcatctactccaccgtggccagctccctggcgctggccatcatggtcgccggcctcttcctgtggatgtgcagcaacgggagcctgcagtgccggatctgcatc

SEQ ID NO: 13101 - RNA, 1704 nt, synthetic construct
  misc_feature 1..1704: note = derived and/or modified sequence opt1 from anti-influenza_Chain
  source 1..1704: mol_type = other RNA
atggagaagatcgtgctgctcctggccatcgtcagcctggtgaagtccgaccagatctgcatcggctaccacgccaacaacagcaccgagcaggtcgacaccatcatggagaagaacgtgacggtgacccacgcgcaggacatcctcgagaagacccacaacgggaagctgtgcgacctggacggcgtgaagcccctcatcctgcgcgactgctccgtcgccgggtggctgctcggcaacccgatgtgcgacgagttcatcaacgtgcccgagtggagctacatcgtggagaaggccaaccccaccaacgacctgtgctaccccgggtccttcaacgactacgaggagctgaagcacctcctgagccggatcaaccacttcgagaagatccagatcatcccgaagtccagctggtccgaccacgaggccagctccggcgtcagctccgcctgcccctacctgggcagcccctccttcttccgcaacgtggtgtggctcatcaagaagaacagcacgtaccccaccatcaagaagtcctacaacaacaccaaccaggaggacctgctggtcctctgggggatccaccacccgaacgacgcggccgagcagacccggctgtaccagaaccccacgacctacatcagcatcggcacctccaccctgaaccagcgcctcgtgcccaagatcgccacgcggagcaaggtgaacgggcagagcggccgcatggagttcttctggaccatcctgaagcccaacgacgccatcaacttcgagtccaacgggaacttcatcgcgccggagtacgcctacaagatcgtcaagaagggcgacagcgccatcatgaagtccgagctggagtacggcaactgcaacaccaagtgccagacccccatgggggccatcaacagctccatgcccttccacaacatccaccccctcacgatcggcgagtgcccgaagtacgtgaagtccaaccggctggtgctggccaccgggctccgcaacagcccccagcgggagagccgccggaagaagcgcggcctgttcggcgcgatcgccgggttcatcgagggcgggtggcagggcatggtcgacgggtggtacggctaccaccactccaacgagcagggcagcgggtacgccgccgacaaggagtccacccagaaggccatcgacggcgtgaccaacaaggtgaacagcatcatcgacaagatgaacacgcagttcgaggcggtcgggcgggagttcaacaacctggagcgccggatcgagaacctcaacaagaagatggaggacggcttcctggacgtgtggacctacaacgccgagctgctcgtgctgatggagaacgagcgcaccctggacttccacgactccaacgtcaagaacctctacgacaaggtgcggctgcagctgcgcgacaacgccaaggagctcgggaacggctgcttcgagttctaccacaagtgcgacaacgagtgcatggagagcatccggaacggcacctacaactacccccagtactccgaggaggcccgcctgaagcgggaggagatcagcggggtcaagctggagtccatcggcacgtaccagatcctcagcatctactccaccgtggccagcagcctggcgctggccatcatgatggccgggctctccctgtggatgtgcagcaacggctccctgcagtgccgcatctgcatc

SEQ ID NO: 13102 - RNA, 1704 nt, synthetic construct
  misc_feature 1..1704: note = derived and/or modified sequence opt1 from anti-influenza_Chain
  source 1..1704: mol_type = other RNA
atggagaagatcgtgctgctgttcgccatcgtcagcctggtgaagtccgaccagatctgcatcggctaccacgccaacaacagcaccgagcaggtcgacaccatcatggagaagaacgtgacggtgacccacgcgcaggacatcctggagaagacccacaacgggaagctctgcgacctggacggcgtgaagcccctgatcctccgcgactgctccgtcgccgggtggctgctgggcaacccgatgtgcgacgagttcatcaacgtgcccgagtggagctacatcgtggagaaggccaaccccgtcaacgacctctgctaccccggggacttcaacgactacgaggagctgaagcacctcctctcccggatcaaccacttcgagaagatccagatcatccccaagagctcctggagctcccacgaggccagcctgggcgtgtccagcgcctgcccgtaccagggcaagtccagcttcttccgcaacgtggtctggctgatcaagaagaactccacctaccccacgatcaagcggagctacaacaacaccaaccaggaggacctcctggtgctgtgggggatccaccaccccaacgacgcggccgagcagaccaagctctaccagaacccgaccacgtacatctccgtgggcaccagcaccctgaaccagcgcctggtcccccggatcgccacccgctccaaggtgaacgggcagagcggccggatggagttcttctggacgatcctcaagcccaacgacgccatcaacttcgagagcaacgggaacttcatcgcgcccgagtacgcctacaagatcgtgaagaagggcgactccaccatcatgaagtccgagctggagtacggcaactgcaacaccaagtgccagaccccgatgggggccatcaacagcagcatgcccttccacaacatccaccccctgacgatcggcgagtgccccaagtacgtcaagtccaaccgcctcgtgctggccaccgggctgcggaacagcccgcagcgcgagcggcgccggaagaagcgcggcctcttcggcgccatcgcggggttcatcgagggcgggtggcagggcatggtggacgggtggtacggctaccaccactccaacgagcagggcagcgggtacgccgccgacaaggagtccacccagaaggccatcgacggcgtcaccaacaaggtgaacagcatcatcgacaagatgaacacgcagttcgaggccgtggggcgggagttcaacaacctggagcgccggatcgagaacctgaacaagaagatggaggacggcttcctcgacgtctggacctacaacgcggagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcgtgcggaacggcacctacgactacccccagtactccgaggaggcccgcctcaagcgcgaggagatcagcggggtcaagctggagtccatcggcatctaccagatcctgagcatctactccacggtggccagctccctcgccctggcgatcatggtggccgggctgagcctctggatgtgcagcaacggctccctgcagtgccggatctgcatc

SEQ ID NO: 13103 - RNA, 1704 nt, synthetic construct; identical to SEQ ID NO: 13100
  misc_feature 1..1704: note = derived and/or modified sequence opt1 from anti-influenza_Chain
  source 1..1704: mol_type = other RNA

SEQ ID NO: 13104 - RNA, 1704 nt, synthetic construct; identical to SEQ ID NO: 13101
  misc_feature 1..1704: note = derived and/or modified sequence opt1 from anti-influenza_Chain
  source 1..1704: mol_type = other RNA

SEQ ID NO: 13105 - RNA, 1704 nt, synthetic construct; identical to SEQ ID NO: 13102
  misc_feature 1..1704: note = derived and/or modified sequence opt1 from anti-influenza_Chain
  source 1..1704: mol_type = other RNA

SEQ ID NO: 13106 - RNA, 1707 nt, synthetic construct
  misc_feature 1..1707: note = derived and/or modified sequence opt1 from anti-influenza_Chain
  source 1..1707: mol_type = other RNA
agcaagtcccgcggctacaagatgaacacccagatcctggtgttcgccctcgtcgccagcatccccaccaacgcggacaagatctgcctggggcaccacgccgtgtccaacggcacgaaggtgaacaccctgaccgagcgcggggtcgaggtggtgaacgccaccgagacggtcgagcggaccaacgtgccgcggatctgcagcaagggcaagcgcaccgtggacctcgggcagtgcggcctgctgggcaccatcacggggccgccccagtgcgaccagttcctcgagttctccgccgacctgatcatcgagcggcgcgagggcagcgacgtctgctaccccgggaagttcgtgaacgaggaggccctgcggcagatcctccgcgagtccggcgggatcgacaaggagaccatgggcttcacctacagcggcatccggaccaacgggacgacctccgcgtgccgccggagcggctccagcttctacgccgagatgaagtggctgctgtccaacaccgacaacgccgccttcccgcagatgaccaagagctacaagaacacgcgcaaggaccccgcgctcatcatctgggggatccaccactccggcagcaccaccgagcagaccaagctgtacggctccgggaacaagctgatcacggtgggcagctccaactaccagcagagcttcgtccccagccccggggcccggccccaggtgaacggccagtccgggcgcatcgacttccactggctcatcctgaaccccaacgacaccgtgaccttcagcttcaacggcgccttcatcgcccccgaccgggcctccttcctgcgcggcaagagcatggggatccagtccgaggtccaggtggacgcgaactgcgagggcgactgctaccacagcgggggcaccatcatctccaacctccccttccagaacatcaacagccgggccgtggggaagtgcccgcgctacgtcaagcaggagtccctgctgctcgccacgggcatgaagaacgtgcccgagatccccaagcggcgccggcgcggcctgttcggggccatcgccggcttcatcgagaacgggtgggagggcctgatcgacgggtggtacggcttccgccaccagaacgcgcagggcgaggggaccgccgccgactacaagagcacccagtccgccatcgaccagatcaccggcaagctcaaccggctgatcgagaagacgaaccagcagttcgagctgatcgacaacgagttcaccgaggtggagcgccagatcgggaacgtcatcaactggacccgggacagcatgaccgaggtgtggtcctacaacgccgagctcctggtggcgatggagaaccagcacacgatcgacctggccgacagcgagatgaacaagctctacgagcgcgtcaagcggcagctgcgcgagaacgccgaggaggacggcaccggctgcttcgagatcttccacaagtgcgacgacgactgcatggcctccatccggaacaacacctacgaccacagcaagtaccgcgaggaggccatccagaaccggatccagatcgaccccgtgaagctgtccagcgggtacaaggacgtcatcctctggttctccttcggcgcgagctgcttcatcctgctggccatcgccatggggctcgtgttcatctgcgtgaagaacggcaacatgcgctgcaccatctgcatc

SEQ ID NO: 13107 - RNA, 1707 nt, synthetic construct; identical to SEQ ID NO: 13106
  misc_feature 1..1707: note = derived and/or modified sequence opt1 from anti-influenza_Chain
  source 1..1707: mol_type = other RNA

SEQ ID NO: 13108 - RNA, 1692 nt, synthetic construct
  misc_feature 1..1692: note = derived and/or modified sequence opt1 from anti-influenza_Chain
  source 1..1692: mol_type = other RNA
gaccagatctgcatcggctaccacgccaacaacagcaccgagaaggtggacaccaacctggagcgcaacgtcacggtgacccacgccaaggacatcctcgagaagacccacaacgggaagctgtgcaagctgaacggcatcccgcccctcgagctgggggactgctccatcgccggctggctgctcgggaaccccgagtgcgaccggctgctgagcgtgcccgagtggtcctacatcatggagaaggagaacccccgcgacggcctctgctacccgggcagcttcaacgactacgaggagctgaagcacctcctgtccagcgtcaagcacttcgagaaggtgaagatcctgcccaaggaccggtggacccagcacacgaccaccgggggctcccgcgcctgcgccgtgagcgggaacccctccttcttccggaacatggtctggctgaccaaggagggcagcgactaccccgtggccaaggggtcctacaacaacacgagcggcgagcagatgctcatcatctggggcgtgcaccacccgatcgacgagaccgagcagcgcaccctgtaccagaacgtcgggacctacgtgtccgtgggcacgagcaccctgaacaagcggtccacccccgagatcgccacccgccccaaggtcaacgggcagggcggccggatggagttcagctggacgctcctggacatgtgggacaccatcaacttcgagtccaccgggaacctgatcgcgcccgagtacggcttcaagatcagcaagcgcgggtccagcggcatcatgaagaccgaggggacgctcgagaactgcgagaccaagtgccagaccccgctgggcgccatcaacaccacgctgcccttccacaacgtgcaccccctcaccatcggcgagtgccccaagtacgtcaagagcgagaagctggtgctggccaccgggctccggaacgtgccgcagatcgagtcccgcggcctgttcggggccatcgcgggcttcatcgagggcgggtggcagggcatggtggacgggtggtacggctaccaccacagcaacgaccaggggtccggctacgccgccgacaaggagagcacccagaaggccttcgacgggatcacgaacaaggtcaactccgtgatcgagaagatgaacacccagttcgaggccgtgggcaaggagttcggcaacctggagcggcgcctcgagaacctgaacaagcggatggaggacgggttcctggacgtctggacctacaacgcggagctcctggtgctgatggagaacgagcgcaccctcgacttccacgacagcaacgtgaagaacctgtacgacaaggtccggatgcagctgcgcgacaacgtgaaggagctcggcaacgggtgcttcgagttctaccacaagtgcgacgacgagtgcatgaactccgtcaagaacggcacgtacgactaccccaagtacgaggaggagagcaagctgaaccggaacgagatcaagggcgtgaagctgtccagcatgggggtgtaccagtccggccgcctcgtcccccgggggagccccggctccgggtacatcccggaggcgccccgcgacggccaggcctacgtgcgcaaggacggcgagtgggtgctgctgagcaccttcctcgggaagcccatccccaacccgctgctgggcctcgactccaccggg

SEQ ID NO: 13109 - RNA, 1692 nt, synthetic construct
  misc_feature 1..1692: note = derived and/or modified sequence opt1 from anti-influenza_Chain
  source 1..1692: mol_type = other RNA
cagaagctgcccggcaacgacaacagcaccgccaccctctgcctggggcaccacgccgtgccgaacggcacgatcgtcaagaccatcaccaacgaccagatcgaggtgaccaacgcgacggagctggtgcagtccagctccaccgggggcatctgcgacagcccccaccagatcctcgacggggagaactgcaccctgatcgacgccctgctcggcgacccccagtgcgacggcttccagaacaagaagtgggacctgttcgtcgagcgctccaaggcctacagcaactgctacccctacgacgtgccggactacgcctccctgcggagcctcgtggcctccagcgggaccctggagttcaacgacgagtccttcaactggacgggcgtcacccagaacgggaccagctccagctgcaagcgccggtccaacaacagcttcttctcccgcctgaactggctcacccagctgaagttcaagtaccccgcgctgaacgtgacgatgcccaacaacgagaagttcgacaagctctacatctggggcgtgcaccaccccgtcaccgacaacgaccagatcttcctgtacgcccaggccagcgggcggatcaccgtgtccaccaagcgcagccagcagacggtgatcccgaacatcggcagccggccccgcatccggaacatcccctcccgcatcagcatctactggaccatcgtcaagcccggcgacatcctgctcatcaactccaccgggaacctgatcgccccgcggggctacttcaagatccgcagcgggaagtccagcatcatgcggtccgacgcgcccatcggcaagtgcaacagcgagtgcatcacccccaacggctccatccccaacgacaagccgttccagaacgtgaaccgcatcacgtacggggcctgcccccggtacgtgaagcagaacaccctgaagctcgccaccggcatgcgcaacgtccccgagaagcagacccgggggatcttcggcgccatcgccgggttcatcgagaacggctgggagggcatggtggacgggtggtacggcttccgccaccagaacagcgaggggatcggccaggcggccgacctgaagtccacgcaggccgccatcaaccagatcaacgggaagctgaaccggctcatcggcaagaccaacgagaagttccaccagatcgagaaggagttcagcgaggtggagggccgcatccaggacctggagaagtacgtcgaggacaccaagatcgacctgtggtcctacaacgccgagctcctggtggcgctggagaaccagcacaccatcgacctcacggacagcgagatgaacaagctgttcgagcggaccaagaagcagctgcgcgagaacgccgaggacatggggaacggctgcttcaagatctaccacaagtgcgacaacgcctgcatcgggtccatccgcaacggcacctacgaccacgacgtgtaccgggacgaggccctcaacaaccgcttccagatcaagggggtcgagctcaagagcggctccggccggctggtgccccgcgggagcccgggctccgggtacatccccgaggcgccccgggacggccaggcctacgtgcgcaaggacggcgagtgggtcctgctgagcaccttcctggggaagcccatcccgaaccccctcctgggcctggacagcacgggg

SEQ ID NO: 13110 - RNA, 1692 nt, synthetic construct; identical to SEQ ID NO: 13108
  misc_feature 1..1692: note = derived and/or modified sequence opt1 from anti-influenza_Chain
  source 1..1692: mol_type = other RNA

SEQ ID NO: 13111 - RNA, 1692 nt, synthetic construct; identical to SEQ ID NO: 13109
  misc_feature 1..1692: note = derived and/or modified sequence opt1 from anti-influenza_Chain
  source 1..1692: mol_type = other RNA

SEQ ID NO: 13112 - RNA, 1695 nt, synthetic construct
  misc_feature 1..1695: note = derived and/or modified sequence opt1 from anti-influenza_Chain
  source 1..1695: mol_type = other RNA
gacaccatctgcatcggctaccacgccaacaacagcaccgacacggtggacaccgtcctggagaagaacgtgaccgtgacccactccgtcaacctcctggaggacagccacaacgggaagctgtgcctcctgaagggcatcgcgcccctgcagctcgggaactgctccgtggccggctggatcctggggaacccggagtgcgagctgctcatcagccgcgagtcctggagctacatcgtggagaagcccaaccccgagaacggcacgtgctaccccggccacttcgccgactacgaggagctgcgggagcagctgtccagcgtctccagcttcgagcgcttcgagatcttcccgaaggagtccagctggcccaaccacaccaccaccggggtgtccgccagctgctcccacaacggcgagagctccttctacaagaacctcctgtggctgacggggaagaacggcctctaccccaacctgagcaagtcctacgccaacaacaaggagaaggaggtgctggtcctctggggcgtgcaccacccgcccaacatcggggaccagcgggccctgtaccacaaggagaacgcgtacgtgagcgtcgtgagctcccactacagccgcaagttcacccccgagatcgccaagcggcccaaggtgcgcgaccaggagggccggatcaactactactggaccctgctcgagcccggggacaccatcatcttcgaggccaacggcaacctgatcgccccgcgctacgcgttcgccctgtcccgggggttcggcagcggcatcatcaactccaacgcccccatggacgagtgcgacgccaagtgccagacgccccagggggccatcaacagctccctccccttccagaacgtccacccggtgaccatcggcgagtgccccaagtacgtgcgcagcgcgaagctgcggatggtcaccgggctgcgcaacatcccctccatccagagccggggcctcttcggggccatcgccggcttcatcgagggcgggtggaccggcatggtggacgggtggtacggctaccaccaccagaacgagcaggggtccggctacgccgccgaccagaagtccacgcagaacgcgatcaacggcatcaccaacaaggtgaacagcgtcatcgagaagatgaacacccagttcaccgccgtggggaaggagttcaacaagctggagcgccggatggagaacctgaacaagaaggtggacgacggcttcatcgacatctggacgtacaacgccgagctcctggtcctgctcgagaacgagcgcaccctggacttccacgacagcaacgtgaagaacctgtacgagaaggtcaagtcccagctcaagaacaacgccaaggagatcgggaacggctgcttcgagttctaccacaagtgcaacgacgagtgcatggagagcgtgaagaacgggacctacgactaccccaagtactccgaggagagcaagctgaaccgggagaagatcgacggcgtgaagctggagtccatgggcgtctaccagagcgggcgcctcgtgccgcggggcagccccgggtccggctacatccccgaggcgccccgcgacggccaggcctacgtgcggaaggacggggagtgggtcctgctgagcaccttcctcggcaagccgatccccaaccccctgctggggctcgactccacgggc

SEQ ID NO: 13113 - RNA, 1695 nt, synthetic construct
  misc_feature 1..1695: note = derived and/or modified sequence opt1 from anti-influenza_Chain
  source 1..1695: mol_type = other RNA
cagaactacaccggcaaccccgtgatctgcctggggcaccacgccgtcagcaacggcaccatggtgaagacgctcaccgacgaccagatcgaggtggtcaccgcccaggagctggtggagtcccagcacctcccggagctgtgccccagccccctgcgcctggtggacgggcagacctgcgacatcgtcaacggcgcgctcgggtcccccggctgcgaccacctgaacggcgccgagtgggacgtgttcatcgagcggccgacggccgtggacacgtgctaccccttcgacgtccccgactaccagagcctgcgctccatcctcgccaacaacgggaagttcgagttcatcgccgaggagttccagtggaacaccgtgaagcagaacggcaagagcggggcgtgcaagcgggccaacgtgaacgacttcttcaaccgcctgaactggctgaccaagtccgacggcaacgcctaccccctccagaacctgaccaaggtcaacaacggggactacgcccggctgtacatctggggcgtgcaccacccgagcaccgacaccgagcagaccaacctctacaagaacaaccccggccgcgtgacggtctccacccagaccagccagacctccgtggtgcccaacatcgggagccggccctgggtccgcggcctgtccagccggatctccttctactggacgatcgtggagccgggggacctgatcgtgttcaacaccatcggcaacctcatcgcgccccgcggccactacaagctgaacagccagaagaagtccaccatcctgaacaccgccgtccccatcgggagctgcgtgtccaagtgccacacggacaagggcagcatcagcaccaccaagcccttccagaacatctcccggatcagcatcggggactgcccgaagtacgtgaagcagggctccctcaagctggccaccgggatgcgcagcatcctggagaaggccacgcggggcctcttcggcgccatcgcggggttcatcgagaacggctggcaggggctgatcgacggctggtacgggttccgccaccagaacgccgagggcaccggcaccgccgccgacctgaagtccacccaggccgcgatcgaccagatcaacgggaagctcaaccggctgatcggcaagcccaacgagaagtaccaccagatcgagaaggagttcgagcaggtcgaggggcgcatccaggacctggagaagtacgtggaggacacgaagatcgacctctggagctacaacgccgagctgctggtcgccctcgagaaccagcacaccatcgacgtgaccgactccgagatgaacaagctgttcgagcgggtgcgccaccagctgcgggagaacgccgaggacaagggcaacgggtgcttcgagatcttccaccagtgcgacaacagctgcatcgagtccatccgcaacggcacctacgaccacgacatctaccgggacgaggccatcaacaaccgcttccagatccagggcgtcaagctcatccaggggtacaaggacagcggccgcctggtgccccgggggtcccccggcagcggctacatcccggaggcgccccgcgacgggcaggcctacgtgcggaaggacggcgagtgggtcctgctctccacgttcctggggaagcccatccccaacccgctgctcggcctggacagcaccggg

SEQ ID NO: 13114 - RNA, 1695 nt, synthetic construct
  misc_feature 1..1695: note = derived and/or modified sequence opt1 from anti-influenza_Chain
  source 1..1695: mol_type = other RNA
gaccagatctgcatcggctaccacgccaacaacagcaccgagcaggtcgacaccatcatggagaagaacgtgacggtgacccacgcccaggacatcctggagaagacccacaacgggaagctctgcaacctggacggcgtgaagcccctgatcctcaaggactgctccgtcgccgggtggctgctgggcaacccgatgtgcgacgagttcctcaacgtgagcgagtggtcctacatcgtggagaaggccagccccgccaacgggctgtgctaccccggcgacttcaacgactacgaggagctgaagcacctcctgtcccgcatcaaccacctgaagaagatcaagatcatccccaagagctactggtccaaccacgaggccagctccggcgtcagcgccgcgtgctcctacctcggggagccgagcttcttccggaacgtggtgtggctgatcaagaagaacaacacctacccgcccatcaaggtcaactacacgaacaccaaccaggaggacctgctcgtgctgtggggcatccaccaccccaacgacgagaaggagcagatccgcatctaccagaaccccaacacctccatcagcgtggggacctccacgctgaaccagcggctcgtccccaagatcgccacccgccccaaggtgaacggccagagcgggcggatggagttcttctggaccatcctgaagcccaacgactccatcaacttcgacagcaacggcaacttcatcgccccggagtacgcctacaagatcgcgaagaagggcgactccgtgatcatgaagtccgagctggagtacgggaactgcaacaccaagtgccagacgcccatgggcgccatcaacagcagcatgcccttccacaacatccaccccctcaccatcggggagtgcccgaagtacgtcaagagcaaccgcctggtgctggccaccggcctccggaacgcgccccagaccgagacgcgcggcctgttcggggccatcgccggcttcatcgagggcgggtggcaggggatggtggacggctggtacggctaccaccactccaacgagcaggggagcggctacgccgccgacaaggagtccacccagaaggccatcgacgggatcaccaacaaggtcaacagcatcatcgacaagatgaacacccagttcgagatcgtgggccgggagttcaacaacctggagcgccggatcgagaacctcaacaagaagatggaggacgggttcctggacgtgtggacgtacaacgccgagctgctcgtcctgatggagaacgagcgcaccctggacttccacgactccaacgtgaagaacctctacgagaaggtgcggctgcagctgcgcgacaacgcgaaggagctcggcaacggctgcttcgagttctaccacaagtgcgacaacgagtgcatggagagcgtccggaacgggacctacgactacccccagtactccgaggaggcccgcctgagccgggaggagatctccggcgtgaagatggagagcatggtcacctaccagtccgggcgcctggtgccccggggcagcccggggtccggctacatccccgaggcgccccgcgacggccaggcctacgtgcggaaggacggggagtgggtcctcctgagcacgttcctgggcaagcccatcccgaaccccctcctggggctggactccaccggc

SEQ ID NO: 13115 - RNA, 1695 nt, synthetic construct; identical to SEQ ID NO: 13112
  misc_feature 1..1695: note = derived and/or modified sequence opt1 from anti-influenza_Chain
  source 1..1695: mol_type = other RNA

SEQ ID NO: 13116 - RNA, 1695 nt, synthetic construct; identical to SEQ ID NO: 13113
  misc_feature 1..1695: note = derived and/or modified sequence opt1 from anti-influenza_Chain
  source 1..1695: mol_type = other RNA

SEQ ID NO: 13117 - RNA, 1695 nt, synthetic construct; identical to SEQ ID NO: 13114
  misc_feature 1..1695: note = derived and/or modified sequence opt1 from anti-influenza_Chain
  source 1..1695: mol_type = other RNA

SEQ ID NO: 13118 - RNA, 1698 nt, synthetic construct
  misc_feature 1..1698: note = derived and/or modified sequence opt1 from anti-influenza_Chain
  source 1..1698: mol_type = other RNA
gacaccctgtgcatcggctaccacgccaacaacagcaccgacacggtggacaccgtcctcgagaagaacgtgaccgtgacccactccgtcaacctgctggaggacaagcacaacgggaagctctgcaagctgcgcggcgtggcgcccctgcacctcgggaagtgcaacatcgcgggctggatcctggggaacccggagtgcgagagcctgtccacggccagctcctggagctacatcgtggagaccccctccagcgacaacgggacctgctaccccggcgacttcatcgactacgaggagctccgggagcagctgtccagcgtctccagcttcgagcgcttcgagatcttccccaagacctccagctggccgaaccacgactccaacaagggcgtgacggccgcctgcccccacgccggcgccaagagcttctacaagaacctgatctggctcgtgaagaaggggaactcctaccccaagctgagcaagtcctacatcaacgacaagggcaaggaggtcctggtgctctgggggatccaccaccccagcaccagcgccgaccagcagtccctgtaccagaacgccgacacctacgtgttcgtcggcagctcccggtacagcaagaagttcaagccggagatcgccatccgccccaaggtgcgggaccaggagggccgcatgaactactactggaccctggtggagcccggggacaagatcacgttcgaggcgaccggcaacctcgtcgtgccccggtacgccttcgccatggagcgcaacgccgggtccggcatcatcatcagcgacaccccggtgcacgactgcaacaccacgtgccagacccccaagggcgccatcaacacctccctgcccttccagaacatccaccccatcaccatcgggaagtgcccgaagtacgtcaagagcacgaagctgcggctcgcgaccggcctgcgcaacatcccctccatccagagccgggggctgttcggcgccatcgccgggttcatcgagggcggctggaccgggatggtggacggctggtacgggtaccaccaccagaacgagcagggctccgggtacgccgccgacctcaagagcacccagaacgcgatcgacgagatcacgaacaaggtgaactccgtcatcgagaagatgaacacccagttcaccgccgtgggcaaggagttcaaccacctggagaagcgcatcgagaacctgaacaagaaggtggacgacggcttcctcgacatctggacctacaacgccgagctgctggtcctcctggagaacgagcggacgctggactaccacgacagcaacgtgaagaacctctacgagaaggtccgctcccagctgaagaacaacgccaaggagatcgggaacggctgcttcgagttctaccacaagtgcgacaacacgtgcatggagagcgtgaagaacgggacctacgactaccccaagtactccgaggaggccaagctgaaccgggaggagatcgacggcgtgaagctcgagagcacccgcatctaccagtccgggcggctggtcccccgcggcagcccgggcagcgggtacatccccgaggcgccccgggacggccaggcctacgtgcgcaaggacggggagtgggtgctgctctccaccttcctgggcaagcccatcccgaaccccctgctcggcctggacagcaccggg

SEQ ID NO: 13119 - RNA, 1698 nt, synthetic construct
  misc_feature 1..1698: note = derived and/or modified sequence opt1 from anti-influenza_Chain
  source 1..1698: mol_type = other RNA
gaccgcatctgcatcggctaccagagcaacaactccaccgacaccgtgaacacgctgatcgagcagaaggtccccgtgacccagaccatggagctcgtggagaccgagaagcacccggcctactgcaacacggacctgggggcgcccctggagctccgggactgcaagatcgaggccgtcatctacggcaaccccaagtgcgacatccacctgaaggaccaggggtggagctacatcgtggagcgcccctccgccccggagggcatgtgctaccccgggagcgtggagaacctggaggagctccggttcgtcttctccagcgccgcctcctacaagcgcatccggctgttcgactacagccgctggaacgtgacctccagcggcacctccaaggcctgcaacgcgagcaccggcgggcagtccttctaccggagcatcaactggctgacgaagaagaagcccgacacctacgacttcaacgagggcacctacgtgaacaacgaggacggggacatcatcttcctctggggcatccaccacccgcccgacaccaaggagcagacgaccctgtacaagaacgccaacaccctgtccagcgtcaccacgaacaccatcaaccgctccttccagcccaacatcgggccccggcccctcgtgcgcggccagcagggccggatggactactactgggggatcctgaagcgcggcgagaccctgaagatccggaccaacgggaacctcatcgccccggagttcggctacctgctgaagggcgagagccacgggcgcacgatccagaacgaggacatccccatcggcaactgctacaccaagtgccagacctacgccggggcgatcaactccagcaagcccttccagaacgccagccggcactacatgggcgagtgccccaagtacgtgaagaaggcctccctccgcctggccgtcgggctgcggaacaccccgagcgtggagccccgcggcctcttcggcgccatcgcggggttcatcgagggcgggtggtccggcatgatcgacgggtggtacggcttccaccacagcaactccgagggcacggggatggccgccgaccagaagtccacccaggaggccatcgacaagatcaccaacaaggtgaacaacatcgtcgacaagatgaaccgggagttcgaggtggtgaaccacgagttcagcgaggtcgagaagcgcatcaacatgatcaacgacaagatcgacgaccagatcgaggacctgtgggcctacaacgcggagctgctcgtgctgctggagaaccagaagaccctcgacgagcacgacagcaacgtgaagaacctgttcgacgaggtcaagcggcgcctgtccgccaacgccatcgacgccggcaacgggtgcttcgacatcctccacaagtgcgacaacgagtgcatggagacgatcaagaacggcacctacgaccacaaggagtacgaggaggaggccaagctggagcgcagcaagatcaacggggtgaagctggaggagaacaccacctacaagtccggccggctcgtgccccgcggcagccccgggtccggctacatcccggaggcgccccgggacgggcaggcctacgtccgcaaggacggcgagtgggtgctgctgagcacgttcctcggcaagcccatccccaacccgctgctggggctcgactccaccggc

SEQ ID NO: 13120 - RNA, 1698 nt, synthetic construct; identical to SEQ ID NO: 13118
  misc_feature 1..1698: note = derived and/or modified sequence opt1 from anti-influenza_Chain
  source 1..1698: mol_type = other RNA

SEQ ID NO: 13121 - RNA, 1698 nt, synthetic construct; identical to SEQ ID NO: 13119
  misc_feature 1..1698: note = derived and/or modified sequence opt1 from anti-influenza_Chain
  source 1..1698: mol_type = other RNA

SEQ ID NO: 13122 - RNA, 1701 nt, synthetic construct
  misc_feature 1..1701: note = derived and/or modified sequence opt1 from anti-influenza_Chain
  source 1..1701: mol_type = other RNA
gacaagatctgcatcggctaccacgccaacaacagcaccacccaggtggacacgatcctggagaagaacgtcaccgtgacccactccgtggagctcctggagaaccagaaggaggagcgcttctgcaagatcctgaacaaggcgcccctcgacctgcgggggtgcaccatcgagggctggatcctggggaacccgcagtgcgacctcctgctgggcgaccagagctggtcctacatcgtcgagcgccccacggcccagaacgggatctgctaccccggcgccctcaacgaggtggaggagctgaaggccctgatcggcagcggggagcgggtggagcgcttcgagatgttccccaagtccacctggaccggcgtcgacaccagctccggggtgacgaaggcctgcccgtacaacagcggctccagcttctaccggaacctcctgtggatcatcaagaccaagtccgccgcctaccccgtgatcaaggggacctacaacaacaccggcagccagcccatcctgtacttctggggcgtccaccacccgcccgacacgaacgagcagaacaccctctacgggtccggcgaccgctacgtgcggatggggaccgagagcatgaacttcgccaagtcccccgagatcgccgcccgccccgcggtgaacggccagcggggccgcatcgactactactggagcgtcctgaagcccggggagaccctgaacgtggagtccaacggcaacctcatcgccccgtggtacgcctacaagttcgtgagcacgaacaacaagggggccatcttcaagtccaacctgcccatcgagaactgcgacgcgacctgccagaccatcgccggcgtcctgcggaccaacaagacgttccagaacgtgagccccctctggatcggggagtgccccaagtacgtcaagagcgagtccctgcgcctggccaccggcctccggaacgtgccgcagatcgagacccgcggcctgttcggggccatcgccggcttcatcgagggcgggtggaccgggatgatcgacggctggtacggctaccaccacgagaacagccaggggtccggctacgccgcggacaaggagagcacgcagaaggccatcgacgggatcaccaacaaggtgaactccatcatcgacaagatgaacacccagttcgaggccgtggaccacgagttcagcaacctggagcggcgcatcgacaacctcaacaagcggatggaggacggcttcctggacgtctggacctacaacgccgagctgctcgtgctgctggagaacgagcgcacgctcgacctgcacgacgccaacgtgaagaacctgtacgagaaggtcaagtcccagctccgggacaacgcgaacgacctggggaacggctgcttcgagttctggcacaagtgcgacaacgagtgcatcgagagcgtgaagaacggcacctacgactaccccaagtaccaggacgagtccaagctgaaccgccaggagatcgagagcgtcaagctcgacaacctgggggtgtaccagtccggccggctggtgccccgcgggagccccggctccggctacatcccggaggcgccccgcgacgggcaggcctacgtccggaaggacggcgagtgggtgctcctgagcaccttcctggggaagcccatccccaacccgctcctgggcctggactccaccggg

SEQ ID NO: 13123 - RNA, 1701 nt, synthetic construct; identical to SEQ ID NO: 13122
  misc_feature 1..1701: note = derived and/or modified sequence opt1 from anti-influenza_Chain
  source 1..1701: mol_type = other RNA

SEQ ID NO: 13124 - RNA, 1704 nt, synthetic construct
  misc_feature 1..1704: note = derived and/or modified sequence opt1 from anti-influenza_Chain
  source 1..1704: mol_type = other RNA
gaccacatctgcatcggctaccacgccaacaacagcaccgagcaggtcgacaccatcatggagaagaacgtgacggtgacccacgcccaggacatcctggagaagacccacaacgggaagctctgcgacctgaacggcgtgaagcccctgatcctcaaggactgctccgtcgccgggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctgtcccgcatcaaccacttcgagaagatccagatcatcccgaaggacagctggtccgaccacgaggccagcctgggcgtctccagcgcctgcccctaccagggcaactccagcttcttccggaacgtggtgtggctgatcaagaaggggaacgcgtaccccaccatcaagaagtcctacaacaacacgaaccaggaggacctcctggtcctgtggggcatccaccaccccaacgacgaggccgagcagacccgcctctaccagaacccgaccacctacatcagcatcgggacgtccaccctgaaccagcggctggtgcccaagatcgccacccgcagcaaggtgaacggccagtccgggcggatcgacttcttctggaccatcctcaagcccaacgacgccatcaacttcgagagcaacggcaacttcatcgcgcccgagtacgcctacaagatcgtcaagaagggcgactccacgatcatgaagtccgaggtggagtacgggaactgcaacacccgctgccagaccccgatgggcgccatcaacagcagcatgcccttccacaacatccaccccctgaccatcggggagtgccccaagtacgtcaagagcaacaagctggtgctcgccacgggcctgcggaactccccgcagcgcgagcggcgccggaagcgcggcctgttcggggccatcgcgggcttcatcgagggcgggtggcaggggatggtggacggctggtacggctaccaccacagcaacgagcaggggtccggctacgccgccgacaaggagagcacccagaaggccatcgacggggtgaccaacaaggtcaactccatcatcgacaagatgaacacccagttcgaggccgtgggccgggagttcaacaacctcgagcgccggatcgagaacctgaacaagaagatggaggacgggttcctggacgtgtggacgtacaacgcggagctcctggtcctgatggagaacgagcgcaccctcgacttccacgacagcaacgtgaagaacctgtacgacaaggtgcggctgcagctccgcgacaacgccaaggagctgggcaacggctgcttcgagttctaccacaagtgcgacaacgagtgcatggagtccgtccggaacgggacctacgactacccccagtacagcgaggaggcccgcctgaagcgggaggagatctccggcgtgaagctcgagagcatcgggacctaccagtccggccgcctggtcccccgcgggagccccggctccggctacatcccggaggcgccccgggacgggcaggcctacgtgcgcaaggacggcgagtgggtgctgctcagcacgttcctggggaagcccatccccaacccgctgctcggcctggactccaccggc

SEQ ID NO: 13125 - RNA, 1704 nt, synthetic construct
  misc_feature 1..1704: note = derived and/or modified sequence opt1 from anti-influenza_Chain
  source 1..1704: mol_type = other RNA
gaccagatctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctgtcccggatcaaccacttcgagaagatccagatcatccccaagagctcctggagcgaccacgaggcctccagcggcgtctccagcgcctgcccctaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagtccggccgcatggacttcttctggaccatcctgaagcccaacgacgccatcaacttcgagagcaacgggaacttcatcgcgcccgagtacgcctacaagatcgtcaagaagggcgactccgccatcgtgaagtccgaggtggagtacggcaactgcaacaccaagtgccagaccccgatcggggccatcaacagcagcatgcccttccacaacatccaccccctcacgatcggcgagtgccccaagtacgtcaagagcaacaagctggtgctggccaccgggctccggaactccccgctgcgcgagcggcgccggaagcgcggcctgttcggcgcgatcgccgggttcatcgagggcgggtggcagggcatggtggacgggtggtacggctaccaccacagcaacgagcagggctccgggtacgccgccgacaaggagagcacccagaaggccatcgacggcgtcaccaacaaggtgaactccatcatcgacaagatgaacacgcagttcgaggcggtggggcgggagttcaacaacctcgagcgccggatcgagaacctgaacaagaagatggaggacggcttcctggacgtctggacctacaacgccgagctcctggtgctgatggagaacgagcgcaccctcgacttccacgacagcaacgtgaagaacctgtacgacaaggtccggctgcagctccgcgacaacgccaaggagctggggaacggctgcttcgagttctaccacaagtgcgacaacgagtgcatggagtccgtgcggaacggcacctacgactacccccagtacagcgaggaggcccgcctgaagcgggaggagatctccggggtcaagctcgagagcatcggcacgtaccagtccgggcgcctggtgccccgcggcagccccgggtccggctacatcccggaggccccgcgggacggccaggcgtacgtgcgcaaggacggggagtgggtcctgctcagcaccttcctgggcaagcccatccccaacccgctgctcgggctggactccaccggc

SEQ ID NO: 13126 - RNA, 1704 nt, synthetic construct; identical to SEQ ID NO: 13124
  misc_feature 1..1704: note = derived and/or modified sequence opt1 from anti-influenza_Chain
  source 1..1704: mol_type = other RNA

SEQ ID NO: 13127 - RNA, 1704 nt, synthetic construct; identical to SEQ ID NO: 13125
  misc_feature 1..1704: note = derived and/or modified sequence opt1 from anti-influenza_Chain
  source 1..1704: mol_type = other RNA

SEQ ID NO: 13128 - RNA, 1707 nt, synthetic construct
  misc_feature 1..1707: note = derived and/or modified sequence opt1 from anti-influenza_Chain
  source 1..1707: mol_type = other RNA
gaccagatctgcatcggctaccacgccaacaacagcaccgagcaggtcgacaccatcatggagaagaacgtgacggtgacccacgcccaggacatcctggagaagaagcacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgtcaacgacctctgctaccccggggacttcaacgactacgaggagctgaagcacctcctgtcccggatcaaccacttcgagaagatccagatcatccccaagagctcctggagctcccacgaggccagcctgggcgtgtccagcgcctgcccctaccagggcaagtccagcttcttccgcaacgtggtctggctgatcaagaagaactccacctaccccaccatcaagcggagctacaacaacacgaaccaggaggacctcctggtgctgtgggggatccaccaccccaacgacgccgcggagcagaccaagctctaccagaacccgaccacctacatctccgtgggcacgagcaccctgaaccagcgcctggtcccccggatcgccacccgctccaaggtgaacgggcagagcggccggatggagttcttctggaccatcctcaagcccaacgacgccatcaacttcgagtccaacgggaacttcatcgcccccgagtacgcgtacaagatcgtgaagaagggcgacagcacgatcatgaagtccgagctggagtacggcaactgcaacaccaagtgccagaccccgatgggggccatcaacagcagcatgcccttccacaacatccaccccctgaccatcggcgagtgccccaagtacgtcaagtccaaccgcctcgtgctggccacggggctgcggaacagcccgcagcgcgagcggcgccggaagaagcgcggcctcttcggcgccatcgccgggttcatcgagggcgggtggcagggcatggtggacgggtggtacggctaccaccactccaacgagcagggcagcgggtacgcggccgacaaggagtccacccagaaggccatcgacggcgtcaccaacaaggtgaacagcatcatcgacaagatgaacacccagttcgaggccgtggggcgggagttcaacaacctggagcgccggatcgagaacctgaacaagaagatggaggacggcttcctcgacgtctggacgtacaacgccgagctgctggtgctcatggagaacgagcgcaccctggacttccacgactccaacgtgaagaacctgtacgacaaggtccggctccagctgcgcgacaacgcgaaggagctggggaacggctgcttcgagttctaccacaagtgcgacaacgagtgcatggagagcgtgcggaacggcacctacgactacccccagtactccgaggaggcccgcctcaagcgcgaggagatcagcggggtcaagctggagtccatcggcatctaccagagcgggcggctggtgccccgcggctcccccgggagcggctacatcccggaggccccgcgggacggccaggcctacgtgcgcaaggacggggagtgggtcctcctgtccaccttcctgggcaagcccatccccaacccgctcctggggctggacagcacgggc

SEQ ID NO: 13129 - RNA, 1707 nt, synthetic construct
  misc_feature 1..1707: note = derived and/or modified sequence opt1 from anti-influenza_Chain
  source 1..1707: mol_type = other RNA
gaccagatctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgccgggtggctgctgggcaacccgatgtgcgacgagttcatcaacgtgcccgagtggagctacatcgtggagaaggccaaccccaccaacgacctctgctaccccgggtccttcaacgactacgaggagctgaagcacctcctgagccggatcaaccacttcgagaagatccagatcatcccgaagtccagctggtccgaccacgaggccagctccggcgtcagctccgcctgcccctacctgggcagcccctccttcttccgcaacgtggtgtggctgatcaagaagaacagcacgtaccccaccatcaagaagtcctacaacaacaccaaccaggaggacctcctggtcctgtgggggatccaccacccgaacgacgccgcggagcagacccggctctaccagaaccccacgacctacatcagcatcggcacctccaccctgaaccagcgcctggtgcccaagatcgccacgcggagcaaggtgaacgggcagtccggccgcatggagttcttctggaccatcctcaagcccaacgacgccatcaacttcgagagcaacgggaacttcatcgccccggagtacgcgtacaagatcgtcaagaagggcgacagcgccatcatgaagtccgagctggagtacggcaactgcaacaccaagtgccagacccccatgggggccatcaacagctccatgcccttccacaacatccaccccctgacgatcggcgagtgcccgaagtacgtgaagtccaaccggctcgtgctggccaccgggctgcgcaacagcccccagcgggagagccgccggaagaagcgcggcctcttcggcgccatcgcggggttcatcgagggcgggtggcagggcatggtcgacgggtggtacggctaccaccactccaacgagcagggcagcgggtacgccgccgacaaggagtccacccagaaggccatcgacggcgtgaccaacaaggtgaacagcatcatcgacaagatgaacacgcagttcgaggccgtcgggcgggagttcaacaacctggagcgccggatcgagaacctgaacaagaagatggaggacggcttcctcgacgtgtggacctacaacgcggagctgctggtgctcatggagaacgagcgcaccctggacttccacgactccaacgtcaagaacctgtacgacaaggtgcggctccagctgcgcgacaacgccaaggagctggggaacggctgcttcgagttctaccacaagtgcgacaacgagtgcatggagagcatccggaacggcacctacaactacccccagtactccgaggaggcccgcctcaagcgggaggagatcagcggggtgaagctggagtccatcggcacgtaccagagcgggcgcctggtcccccgcggctccccggggagcggctacatccccgaggcgccccgggacggccaggcctacgtgcgcaaggacggggagtgggtcctcctgtccaccttcctgggcaagcccatcccgaaccccctcctggggctggacagcaccggc

SEQ ID NO: 13130 - RNA, 1707 nt, synthetic construct
  misc_feature 1..1707: note = derived and/or modified sequence opt1 from anti-influenza_Chain
  source 1..1707: mol_type = other RNA
gaccagatctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcctcaacgtgagcgagtggtcctacatcgtggagaagatcaaccccgccaacgacctgtgctaccccgggaacttcaacaactacgaggagctgaagcacctcctgagccggatcaaccgcttcgagaagatccagatcatccccaagtccagctggccggaccacgaggcctccctgggcgtcagctccgcctgcccctaccagggcgggcccagcttctaccggaacgtggtgtggctcatcaagaagaacaacacctaccccacgatcaagaagtcctaccacaacaccaaccaggaggacctgctggtcctctggggcatccaccacccgaacgacgaggccgagcagacccgcatctacaagaaccccaccacgtacatcagcgtggggacctccaccctgaaccagcggctggtgcccaagatcgcgacccgcagcaaggtcaacggccagtccgggcgggtggagttcttctggacgatcctcaagagcaacgacaccatcaacttcgagtccaacggcaacttcatcgcccccgagaacgcctacaagatcgtgaagaagggcgacagcaccatcatgaagtccgagctggagtacgggaactgcaacaccaagtgccagacgccgatcggcgccatcaacagcagcatgcccttccacaacatccaccccctgaccatcggggagtgccccaagtacgtcaagtccaaccgcctcgtgctggcgaccggcctgcggaacagcccgcagggcgagcgccggcgcaagaagcggggcctcttcggggccatcgccgggttcatcgagggcgggtggcagggcatggtggacggctggtacgggtaccaccactccaacgagcagggcagcgggtacgccgccgacaaggagtccacccagaaggcgatcgacggcgtcacgaacaaggtgaacagcatcatcgacaagatgaacacccagttcgaggccgtggggcgcgagttcaacaacctggagcggcgcatcgagaacctgaacaagaagatggaggacggcttcctcgacgtctggacctacaacgccgagctgctggtgctcatggagaacgagcggaccctggacttccacgactccaacgtgaagaacctgtacgacaaggtccgcctccagctgcgggacaacgccaaggagctgggcaacgggtgcttcgagttctaccaccgctgcgacaacgagtgcatggagagcgtgcggaacggcacgtacgactacccccagtactccgaggaggcccgcctcaagcgcgaggagatcagcggggtcaagctggagtccatcggcacctaccagagcgggcggctggtgccccgcggctcccccggcagcgggtacatcccggaggcgccccgggacggccaggcctacgtgcgcaaggacggggagtgggtcctcctgtccaccttcctgggcaagcccatccccaacccgctcctgggcctggacagcaccggg

SEQ ID NO: 13131 - RNA, 1707 nt, synthetic construct; identical to SEQ ID NO: 13128
  misc_feature 1..1707: note = derived and/or modified sequence opt1 from anti-influenza_Chain
  source 1..1707: mol_type = other RNA

SEQ ID NO: 13132 - RNA, 1707 nt, synthetic construct; identical to SEQ ID NO: 13129
  misc_feature 1..1707: note = derived and/or modified sequence opt1 from anti-influenza_Chain
  source 1..1707: mol_type = other RNA

SEQ ID NO: 13133 - RNA, 1707 nt, synthetic construct; identical to SEQ ID NO: 13130
  misc_feature 1..1707: note = derived and/or modified sequence opt1 from anti-influenza_Chain
  source 1..1707: mol_type = other RNA

SEQ ID NO: 13134 - RNA, 1728 nt, synthetic construct
  misc_feature 1..1728: note = derived and/or modified sequence opt1 from anti-influenza_Chain
  source 1..1728: mol_type = other RNA
atctgcatcggctaccacgccaacaacagcaccgagcaggtcgacaccatcatggagaagaacgtgacggtgacccacgcccaggacatcctggagaagacccacaacgggaagctctgcgacctggacggcgtgaagcccctgatcctccgcgactgctccgtcgcggggtggctgctgggcaacccgatgtgcgacgagttcatcaacgtgcccgagtggagctacatcgtggagaaggccaaccccgccaacgacctctgctaccccgggaacttcaacgactacgaggagctgaagcacctcctgtcccggatcaaccacttcgagaagatccagatcatccccaagagctcctggagcgaccacgaggcctccagcggcgtctccagcgcctgcccctaccagggcaccccctccttcttccgcaacgtggtgtggctgatcaagaagaacaacacgtaccccaccatcaagcggagctacaacaacaccaaccaggaggacctgctcatcctgtgggggatccaccactccaacgacgcggccgagcagaccaagctgtaccagaacccgacgacctacatcagcgtcggcacctccaccctcaaccagcgcctggtgcccaagatcgccacgcggagcaaggtgaacgggcagaacggccgcatggacttcttctggaccatcctgaagcccaacgacgccatcaacttcgagtccaacgggaacttcatcgcgcccgagtacgcctacaagatcgtcaagaagggcgacagcgccatcgtgaagtccgaggtggagtacggcaactgcaacaccaagtgccagaccccgatcggggccatcaacagcagcatgcccttccacaacatccaccccctcacgatcggcgagtgccccaagtacgtcaagtccaacaagctggtgctggccaccgggctccggaacagcccgctgggctacatccccgaggcgccccgcgacggccaggcctacgtgcggaaggacggggagtgggtcctgctctccaccttcctgcgcagcgacaagacccacacgtgcccgccgtgccccgcccccgagctgctcggcgggccctccgtgttcctgttcccgcccaagcccaaggacaccctgatgatcagccggacccccgaggtgacctgcgtcgtggtggacgtctcccacgaggacccggaggtgaagttcaactggtacgtcgacggcgtggaggtgcacaacgccaagacgaagccccgcgaggagcagtacaacagcacctaccgggtcgtgtccgtgctcaccgtcctgcaccaggactggctgaacgggaaggagtacaagtgcaaggtgagcaacaaggccctccccgcgccgatcgagaagaccatctccaaggccaagggccagccccgcgagccccaggtgtacacgctgcccccgagccgggaggagatgaccaagaaccaggtctccctgacctgcctcgtgaagggcttctaccccagcgacatcgccgtggagtgggagtccaacgggcagcccgagaacaactacaagaccacgcccccggtcctggacagcgacggctccttcttcctgtacagcaagctcaccgtggacaagtcccgctggcagcaggggaacgtgttcagctgcagcgtcatgcacgaggccctgcacaaccactacacccagaagtccctgagcctctcccccggcaag

SEQ ID NO: 13135 - RNA, 1728 nt, synthetic construct
  misc_feature 1..1728: note = derived and/or modified sequence opt1 from anti-influenza_Chain
  source 1..1728: mol_type = other RNA
atggtggtcaccagcaacgccgaccgcatctgcaccggcatcacgtccagcaacagcccccacgtggtgaagaccgccacccagggggaggtcaacgtgaccggcgtgatcccgctgacgaccacccccaccaagagccacttcgcgaacctcaaggggacggagacccggggcaagctgtgccccaagtgcctgaactgcaccgacctcgacgtcgccctggggcgccccaagtgcaccggcaacatcccgtccgcccgggtgagcatcctgcacgaggtgcgccccgtcacgtccggctgcttccccatcatgcacgaccggaccaagatccgccagctccccaacctgctgcgggggtacgagcacatccgcctcagcacccacaacgtgatcaacgccgagaacgccccgggcgggccctacaagatcggcacctccgggagctgccccaacgtgacgaacggcaacggcttcttcgcgaccatggcctgggccgtccccaagaacgacaacaacaagaccgccaccaactccctgacgatcgaggtgccgtacatctgcaccgagggggaggaccagatcaccgtgtggggcttccacagcgacaacgagacccagatggcgaagctgtacggggactccaagccccagaagttcacgagctccgccaacggcgtcaccacccactacgtgagccagatcggcgggttccccaaccagaccgaggacggcgggctcccccagtccggccggatcgtggtcgactacatggtgcagaagtccgggaagacgggcaccatcacctaccagcgcggcatcctgctgccgcagaaggtgtggtgcgcctccggcaagagcaaggtcatcaaggggagcctccccctgatcggggaggccgactgcctgcacgagaagtacggcgggctcaacaagtccaagccctactacaccggcgagcacgccaaggcgatcggcaactgccccatctgggtgaagacgccgctgaagctggccaacgggaccaagtaccggccgcccgccaagctcctgaaggagcgcggcttcttcggggccatcgccggcttcctggagggcgggtgggagggcatgatcgcggggtggcacggctacaccagccacggggcccacggcgtggccgtcgccgccgacctcaagtccacccaggaggcgatcaacaagatcacgaagaacctgaacagcctgtccgagctcgaggtgaagaacctgcagcggctgagcggcgccatggacgagctccacaacgagatcctggagctggacgagaaggtcgacgacctccgcgccgacaccatctccagccagatcgagctggccgtgctgctctccaacgaggggatcatcaacagcgaggacgagcacctcctggccctggagcggaagctgaagaagatgctgggcccctccgcggtggagatcgggaacggctgcttcgagaccaagcacaagtgcaaccagacctgcctcgaccgcatcgccgccgggaccttcgacgccggcgagttcagcctgcccacgttcgactccctgaacatcaccgcggccagcctcaacgacgacggcctggacaaccacaccatcctgctctactactccaccgccgccagctccctggccgtcacgctgatgatcgcgatcttcgtggtgtacatggtcagccgggacaacgtgtcctgcttccacagc

SEQ ID NO: 13136 - RNA, 1728 nt, synthetic construct; identical to SEQ ID NO: 13135
  misc_feature 1..1728: note = derived and/or modified sequence opt1 from anti-influenza_Chain
  source 1..1728: mol_type = other RNA

SEQ ID NO: 13137 - RNA, 1728 nt, synthetic construct; identical to SEQ ID NO: 13134
  misc_feature 1..1728: note = derived and/or modified sequence opt1 from anti-influenza_Chain
  source 1..1728: mol_type = other RNA

SEQ ID NO: 13138 - RNA, 1731 nt, synthetic construct
  misc_feature 1..1731: note = derived and/or modified sequence opt1 from anti-influenza_Chain
  source 1..1731: mol_type = other RNA
gccaaggccggcgtgcagagcgtcaagatggagaagatcgtgctgctgttcgcgatcgtgtccctggtcaagagcgaccagatctgcatcgggtaccacgccaacaactccaccgagcaggtcgacaccatcatggagaagaacgtgacggtgacccacgcccaggacatcctggagaagacccacaacggcaagctctgcgacctggacggggtgaagcccctgatcctccgcgactgcagcgtggccggctggctgctggggaacccgatgtgcgacgagttcatcaacgtccccgagtggtcctacatcgtggagaaggccaaccccgtgaacgacctctgctaccccggcgacttcaacgactacgaggagctgaagcacctcctcagccggatcaaccacttcgagaagatccagatcatcccgaagtccagctggtccagccacgaggcgtccctgggcgtcagctccgcctgcccctaccagggcaagagctccttcttccgcaacgtggtgtggctgatcaagaagaacagcacctaccccacgatcaagcggtcctacaacaacaccaaccaggaggacctcctggtcctgtgggggatccaccaccccaacgacgccgccgagcagaccaagctctaccagaacccgaccacgtacatcagcgtggggacctccaccctgaaccagcgcctggtgccccggatcgcgacccgcagcaaggtcaacggccagagcgggcggatggagttcttctggacgatcctcaagcccaacgacgccatcaacttcgagtccaacggcaacttcatcgcccccgagtacgcctacaagatcgtgaagaagggcgacagcaccatcatgaagtccgagctggagtacgggaactgcaacaccaagtgccagaccccgatgggcgccatcaacagctccatgcccttccacaacatccaccccctgacgatcggggagtgccccaagtacgtcaagagcaaccgcctcgtgctggcgaccggcctgcggaactccccgcagcgcgagcggcgccggaagaagcgcggcctcttcggggccatcgccggcttcatcgagggcgggtggcaggggatggtggacggctggtacggctaccaccacagcaacgagcaggggtccggctacgccgccgacaaggagagcacccagaaggcgatcgacggggtgaccaacaaggtcaactccatcatcgacaagatgaacacgcagttcgaggccgtgggccgggagttcaacaacctggagcgccggatcgagaacctgaacaagaagatggaggacgggttcctcgacgtctggacctacaacgccgagctgctggtgctcatggagaacgagcgcaccctggacttccacgacagcaacgtgaagaacctgtacgacaaggtccggctccagctgcgcgacaacgccaaggagctgggcaacggctgcttcgagttctaccacaagtgcgacaacgagtgcatggagtccgtgcggaacgggacctacgactacccccagtacagcgaggaggcccgcctcaagcgcgaggagatctccggcgtgaagctggagagcatcgggatctaccagatcctgtccatctacagcacggtcgcgtccagcctcgccctggccctgatggtggccggcctcagcctgtggatgtgctccaacgggagcctgcagtgccggatctgcatc

SEQ ID NO: 13139 - RNA, 1731 nt, synthetic construct; identical to SEQ ID NO: 13138
  misc_feature 1..1731: note = derived and/or modified sequence opt1 from anti-influenza_Chain
  source 1..1731: mol_type = other RNA

SEQ ID NO: 13140 - RNA, 1737 nt, synthetic construct
  misc_feature 1..1737: note = derived and/or modified sequence opt1 from anti-influenza_Chain
  source 1..1737: mol_type = other RNA
atggtggtcaccagcaacgccgaccgcatctgcaccggcatcacgtccagcaacagcccccacgtggtgaagaccgccacccagggggaggtcaacgtgaccggcgtgatcccgctgacgaccacccccaccaagtcccacttcgcgaacctcaaggggacgcagacccggggcaagctgtgccccaactgcctgaactgcaccgacctcgacgtcgccctggggcgccccaagtgcatgggcaccatcccgtccgccaaggccagcatcctgcacgaggtgaagcccgtgacgtccggctgcttccccatcatgcacgaccggaccaagatccgccagctccccaacctgctgcgggggtacgagaacatccgcctcagcgcccggaacgtcatcaacgcggagaccgccccgggcgggccctacatcgtgggcacctccgggagctgccccaacgtgacgaacggcaagggcttcttcgccaccatggcctgggcggtccccaagaacaagaacaagaccgccaccaacccgctgacggtggaggtgccctacatctgcaccaagggggaggaccagatcaccgtctggggcttccactccgacaacgaggcccagatggtgaccctgtacggggacagcaagccccagaagttcacgtccagcgccaacggcgtgaccacccactacgtctcccagatcggcgggttccccaaccagaccgaggacgagggcctccagcagagcgggcgcatcgtggtggactacatggtccagaagccgggcaagacggggaccatcgtgtaccagcggggcgtgctgctgccccagaaggtctggtgcgcctccggccgcagcaaggtgatcaaggggtccctccccctgatcggcgaggcggactgcctgcacgagaagtacgggggcctcaacaagagcaagccctactacaccggggagcacgccaaggccatcggcaactgcccgatctgggtcaagacgcccctgaagctggccaacggcaccaagtaccggccgcccgccaagctcctgaaggagcgcgggttcttcggcgcgatcgccgggttcctggagggcgggtgggagggcatgatcgccggctggcacgggtacaccagccacggcgcccacggggtggccgtggcggccgacctcaagtccacccaggaggccatcaacaagatcaccaagaacctgaacagcctgtccgagctcgaggtcaagaacctgcagcggctgagcggcgccatggacgagctccacaacgagatcctggagctggacgagaaggtggacgacctccgcgccgacacgatctccagccagatcgagctggcggtgctgctctccaacgagggcatcatcaacagcgaggacgagcacctcctggccctggagcggaagctgaagaagatgctggggccctccgccgtcgacatcggcaacgggtgcttcgagaccaagcacaagtgcaaccagacctgcctcgaccgcatcgccgcgggcaccttcaacgccggggagttcagcctgcccaccttcgactccctgaacatcacggccgccagcctcaacgacgacggcctggacaaccacaccatcctgctctactactccaccgccgcgagctccctggccgtgaccctgatgatcgccatcttcatcgtgtacatggtcagccgggacaacgtgttcctgctccacctgtccatccgcaag

SEQ ID NO: 13141 - RNA, 1737 nt, synthetic construct; identical to SEQ ID NO: 13140
  misc_feature 1..1737: note = derived and/or modified sequence opt1 from anti-influenza_Chain
  source 1..1737: mol_type = other RNA

SEQ ID NO: 13142 - RNA, 1731 nt, synthetic construct
  misc_feature 1..1731: note = derived and/or modified sequence opt1 from anti-influenza_Chain
  source 1..1731: mol_type = other RNA
atggagaccatcagcctgatcaccatcctcctggtggtcacggcctccaacgccgacaagatctgcatcggccaccagagcaccaactccaccgagaccgtggacacgctgaccgagaccaacgtgcccgtcacccacgccaaggagctcctgcacacggagcacaacgggatgctgtgcgccaccagcctcggccacccgctgatcctggacacgtgcaccatcgaggggctcgtgtacggcaacccctcctgcgacctgctgctcgggggccgcgagtggagctacatcgtggagcggtccagcgccgtcaacgggacctgctaccccggcaacgtggagaacctggaggagctgcgcaccctcttctccagcgcctccagctaccagcggatccagatcttccccgacaccacctggaacgtgacgtacaccggcacctcccgcgcctgcagcgggtccttctaccggagcatgcgctggctgacccagaagtccggcttctacccggtccaggacgcgcagtacacgaacaaccggggcaagagcatcctgttcgtgtgggggatccaccacccgcccacctacaccgagcagaccaacctctacatccgcaacgacacgaccacctccgtgaccacggaggacctgaaccggaccttcaagcccgtcatcggcccccgccccctggtgaacgggctccagggccggatcgactactactggagcgtgctgaagcccgggcagaccctgcgcgtccggagcaacggcaacctcatcgccccctggtacggccacgtgctgtccgggggcagccacgggcgcatcctgaagaccgacctcaagggcgggaactgcgtggtccagtgccagacggagaagggcggcctgaactccaccctgccgttccacaacatcagcaagtacgccttcgggacctgccccaagtacgtgcgggtgaactccctcaagctggccgtcggcctgcgcaacgtgcccgcgcggagctcccgcggcctcttcggggccatcgccgggttcatcgagggcggctggcccgggctggtggccggctggtacgggttccagcacagcaacgaccagggcgtcgggatggccgcggaccgggactccacccagaaggccatcgacaagatcacgagcaaggtgaacaacatcgtcgacaagatgaacaagcagtacgagatcatcgaccacgagttctccgaggtggagacccgcctgaacatgatcaacaacaagatcgacgaccagatccaggacgtgtgggcctacaacgccgagctcctggtcctgctcgagaaccagaagaccctggacgagcacgacgccaacgtgaacaacctgtacaacaaggtgaagcgggcgctcggcagcaacgccatggaggacggcaaggggtgcttcgagctgtaccacaagtgcgacgaccagtgcatggagaccatccgcaacggcacctacaaccgccggaagtaccgcgaggagtcccggctggagcgccagaagatcgagggggtcaagctcgagagcgagggcacgtacaagtccggccggctggtgccgcgcgggagccccggctccgggtacatccccgaggcgccccgggacggccaggcctacgtgcgcaaggacggggagtgggtcctgctcagcaccttcctgggcaagccgatccccaaccccctgctgggcctcgactccaccggg

SEQ ID NO: 13143 - RNA, 1731 nt, synthetic construct; identical to SEQ ID NO: 13142
  misc_feature 1..1731: note = derived and/or modified sequence opt1 from anti-influenza_Chain
  source 1..1731: mol_type = other RNA

SEQ ID NO: 13144 - RNA, 1752 nt, synthetic construct
  misc_feature 1..1752: note = derived and/or modified sequence opt1 from anti-influenza_Chain
  source 1..1752: mol_type = other RNA
atgaaggccatcatcgtgctgctcatggtcgtgaccagcaacgccgaccgcatctgcaccggcatcacgtccagcaacagcccccacgtggtcaagaccgcgacccagggggaggtgaacgtgaccggcgtcatcccgctgacgaccacccccaccaagtcccacttcgccaacctgaaggggacgcagacccggggcaagctctgccccaactgcttcaactgcaccgacctggacgtggccctggggcgccccaagtgcatgggcaacaccccgtccgccaaggtgagcatcctccacgaggtcaagcccgccacgtccggctgcttccccatcatgcacgaccggaccaagatccgccagctgcccaacctgctccgggggtacgagaacatccgcctgagcacctccaacgtgatcaacaccgagacggcgccgggcgggccctacaaggtgggcaccagcgggtcctgccccaacgtcgccaacggcaacggcttcttcaacaccatggcctgggtgatccccaaggacaacaacaagaccgccatcaacccggtgacggtcgaggtgccctacatctgcagcgagggggaggaccagatcaccgtgtggggcttccactccgacgacaagacccagatggagcggctgtacggggacagcaacccccagaagttcacctccagcgcgaacggcgtcacgacccactacgtgtcccagatcggcgggttccccaaccagaccgaggacgagggcctcaagcagagcgggcgcatcgtggtcgactacatggtgcagaagccgggcaagaccgggacgatcgtgtaccagcggggcatcctgctgccccagaaggtctggtgcgcctccggccgcagcaaggtgatcaaggggagcctccccctgatcggcgaggccgactgcctgcacgagaagtacgggggcctcaacaagtccaagccctactacaccggggagcacgccaaggccatcggcaactgcccgatctgggtcaagacgcccctgaagctggcgaacggcaccaagtaccggccgcccgccaagctcctgaaggagcgcgggttcttcggcgccatcgccgggttcctggagggcgggtgggagggcatgatcgccggctggcacgggtacaccagccacggcgcgcacggggtggccgtggccgccgacctcaagtccacccaggaggccatcaacaagatcaccaagaacctgaactacctgagcgagctcgaggtcaagaacctgcagcggctgtccggcgcgatgaacgagctccacgacgagatcctggagctggacgagaaggtggacgacctccgcgccgacaccatcagctcccagatcgagctggccgtgctgctcagcaacgagggcatcatcaactccgaggacgagcacctcctggccctggagcggaagctgaagaagatgctggggcccagcgccgtcgagatcggcaacgggtgcttcgagacgaagcacaagtgcaaccagacctgcctcgaccgcatcgcggccggcaccttcaacgccggggacttctccctgcccaccttcgacagcctgaacatcaccgccgcgtccctcaacgacgacggcctggacaaccacacgatcctgctctactacagcaccgccgcctccagcctggccgtgaccctgatgatcgccatcttcatcgtgtacatggtctcccgggacaacgtgagctgctccatctgcctg

SEQ ID NO: 13145 - RNA, 1752 nt, synthetic construct
  misc_feature 1..1752: note = derived and/or modified sequence opt1 from anti-influenza_Chain
  source 1..1752: mol_type = other RNA
atgaaggccatcatcgtgctgctcatggtcgtgaccagcaacgccgaccgcatctgcaccggcatcacgtccagcaacagcccccacgtggtcaagaccgcgacccagggggaggtgaacgtgaccggcgtcatcccgctgacgaccacccccaccaagtcctacttcgccaacctgaaggggacgaagacccggggcaagctctgccccgactgcctgaactgcaccgacctggacgtggccctcgggcgccccatgtgcgtgggcaccacgccgtccgccaaggccagcatcctgcacgaggtccggcccgtgacctccggctgcttccccatcatgcacgaccgcaccaagatccggcagctggcgaacctcctgcgcgggtacgagaacatccggctgagcacccagaacgtgatcgacgccgagaaggcccccggcgggccgtaccgcctcggcacgtccgggagctgccccaacgccacctccaagagcggcttcttcgcgaccatggcctgggccgtccccaaggacaacaacaagaacgccaccaaccccctgacggtggaggtgccgtacatctgcaccgagggcgaggaccagatcaccgtctgggggttccactccgacgacaagacccagatgaagaacctgtacggcgacagcaacccccagaagttcacgtccagcgccaacggggtgaccacccactacgtgtcccagatcggcggcttccccgaccagaccgaggacgggggcctcccccagagcgggcggatcgtcgtggactacatgatgcagaagccgggcaagacggggaccatcgtgtaccagcgcggcgtcctgctgccccagaaggtgtggtgcgcgtccggccggagcaaggtgatcaaggggagcctccccctgatcggcgaggccgactgcctgcacgagaagtacgggggcctcaacaagtccaagccctactacaccggggagcacgccaaggccatcggcaactgcccgatctgggtcaagacgcccctgaagctggccaacggcaccaagtaccgcccgcccgcgaagctcctgaaggagcgggggttcttcggcgccatcgccgggttcctggagggcgggtgggagggcatgatcgccggctggcacgggtacaccagccacggcgcccacggggtggcggtcgccgccgacctcaagtccacccaggaggccatcaacaagatcaccaagaacctgaacagcctgtccgagctcgaggtgaagaacctgcagcgcctgagcggcgccatggacgagctccacaacgagatcctggagctggacgagaaggtggacgacctccgggcggacacgatctccagccagatcgagctggccgtcctgctctccaacgagggcatcatcaacagcgaggacgagcacctcctggccctggagcgcaagctgaagaagatgctggggccctccgccgtggacatcggcaacgggtgcttcgagaccaagcacaagtgcaaccagacctgcctcgaccggatcgcggccggcaccttcaacgccggggagttcagcctgcccaccttcgactccctgaacatcacggccgccagcctcaacgacgacggcctggacaaccacaccatcctgctgtactactccaccgcggccagctccctcgccgtgaccctgatgctggccatcttcatcgtctacatggtgagccgcgacaacgtgtcctgcagcatctgcctc

SEQ ID NO: 13146 - RNA, 1752 nt, synthetic construct
  misc_feature 1..1752: note = derived and/or modified sequence opt1 from anti-influenza_Chain
  source 1..1752: mol_type = other RNA
atgaaggccatcatcgtgctgctcatggtcgtgaccagcaacgccgaccgcatctgcaccggcatcacgtccagcaacagcccccacgtggtcaagaccgcgacccagggggaggtgaacgtgaccggcgtcatcccgctgacgaccacccccaccaagtcctacttcgccaacctgaaggggacgcggacccgcggcaagctctgccccgactgcctgaactgcaccgacctggacgtggccctcgggcggcccatgtgcgtgggcaccacgccgtccgccaaggccagcatcctgcacgaggtcaagcccgtgacctccggctgcttccccatcatgcacgaccgcaccaagatccggcagctgcccaacctcctgcgcgggtacgagaacatccggctgagcacccagaacgtgatcgacgcggagaaggccccgggcgggccctaccgcctcggcacgtccgggagctgccccaacgccacctccaagagcggcttcttcgccaccatggcgtgggccgtccccaaggacaacaacaagaacgccaccaacccgctgacggtggaggtgccctacatctgcaccgagggcgaggaccagatcaccgtctgggggttccactccgacgacaagacccagatgaagaacctgtacggcgacagcaacccccagaagttcacgtccagcgccaacggggtgaccacccactacgtgtcccagatcggcagcttccccgaccagaccgaggacggcgggctcccgcagtccggccggatcgtcgtggactacatgatgcagaagcccgggaagacgggcaccatcgtgtaccagcgcggggtcctgctgccccagaaggtgtggtgcgccagcggccggagcaaggtgatcaagggctccctccccctgatcggggaggcggactgcctgcacgagaagtacggcgggctcaacaagagcaagccgtactacaccggcgagcacgccaaggccatcgggaactgccccatctgggtcaagacgcccctgaagctggccaacggcaccaagtaccggcccccggccaagctcctgaaggagcgcggcttcttcggggcgatcgccggcttcctggagggcgggtgggaggggatgatcgccggctggcacggctacacctcccacggggcccacggcgtggccgtcgcggccgacctcaagagcacccaggaggccatcaacaagatcaccaagaacctgaactccctgagcgagctcgaggtgaagaacctgcagcgcctgtccggggccatggacgagctccacaacgagatcctggagctggacgagaaggtggacgacctccgggccgacacgatcagctcccagatcgagctggcggtcctgctcagcaacgagggcatcatcaactccgaggacgagcacctcctggccctggagcgcaagctgaagaagatgctgggccccagcgccgtggagatcgggaacggctgcttcgagaccaagcacaagtgcaaccagacctgcctcgaccggatcgccgcggggaccttcaacgccggcgagttctccctgcccaccttcgacagcctgaacatcacggccgcctccctcaacgacgacgggctggacaaccacaccatcctgctgtactacagcaccgccgcgtccagcctcgccgtgaccctgatgctggccatcttcatcgtctacatggtgtcccgcgacaacgtgagctgcagcatctgcctc

SEQ ID NO: 13147 - RNA, 1752 nt, synthetic construct; identical to SEQ ID NO: 13144
  misc_feature 1..1752: note = derived and/or modified sequence opt1 from anti-influenza_Chain
  source 1..1752: mol_type = other RNA

SEQ ID NO: 13148 - RNA, 1752 nt, synthetic construct; identical to SEQ ID NO: 13145
  misc_feature 1..1752: note = derived and/or modified sequence opt1 from anti-influenza_Chain
  source 1..1752: mol_type = other RNA

SEQ ID NO: 13149 - RNA, 1752 nt, synthetic construct; identical to SEQ ID NO: 13146
  misc_feature 1..1752: note = derived and/or modified sequence opt1 from anti-influenza_Chain
  source 1..1752: mol_type = other RNA

SEQ ID NO: 13150 - RNA, 1758 nt, synthetic construct
  misc_feature 1..1758: note = derived and/or modified sequence opt1 from anti-influenza_Chain
  source 1..1758: mol_type = other RNA
atgaaggccatcatcgtgctgctcatggtcgtgaccagcaacgccgaccgcatcatctgcaccggcatcacgtccagcaacagcccccacgtggtcaagaccgcgacccagggggaggtgaacgtgaccggcgtcatcccgctgacgaccacccccaccaagagccacttcgccaacctgaaggggacggagacccggggcaagctctgccccaagtgcctgaactgcaccgacctggacgtggccctcgggcgccccaagtgcaccggcaacatcccgtccgcccgggtgagcatcctgcacgaggtccgccccgtgacgtccggctgcttccccatcatgcacgaccggaccaagatccgccagctgcccaacctcctgcgggggtacgagcacatccgcctgagcacccacaacgtgatcaacgccgagaacgcgccgggcgggccctacaagatcggcacctccgggagctgccccaacgtcacgaacggcaacggcttcttcgccaccatggcctgggccgtgcccaagaacgacaacaacaagaccgcgaccaactccctcacgatcgaggtgccgtacatctgcaccgagggggaggaccagatcaccgtctggggcttccacagcgacaacgagacccagatggccaagctgtacggggactccaagccccagaagttcacgagctccgccaacggcgtgaccacccactacgtgagccagatcggcgggttccccaaccagaccgaggacggcgggctgccccagtccggccggatcgtcgtggactacatggtgcagaagtccgggaagacgggcaccatcacctaccagcgcggcatcctcctgccgcagaaggtctggtgcgcctccgggcggagcaaggtgatcaagggcagcctgcccctcatcggggaggccgactgcctgcacgagaagtacggcgggctgaacaagtccaagccctactacaccggcgagcacgcgaaggccatcggcaactgccccatctgggtgaagacgccgctcaagctggccaacgggaccaagtaccgcccgcccgccaagctgctcaaggagcggggcttcttcggggccatcgcgggcttcctggagggcgggtgggagggcatgatcgccgggtggcacggctacaccagccacggggcccacggcgtcgccgtggccgcggacctgaagtccacccaggaggccatcaacaagatcacgaagaacctcaacagcctgtccgagctggaggtcaagaacctccagcgcctgagcggcgccatggacgagctgcacaacgagatcctcgagctggacgagaaggtggacgacctgcgggccgacaccatctccagccagatcgagctcgccgtgctgctgtccaacgaggggatcatcaacagcgaggacgagcacctcctggcgctggagcgcaagctcaagaagatgctgggcccctccgccgtcgagatcgggaacggctgcttcgagaccaagcacaagtgcaaccagacctgcctggaccggatcgccgccgggaccttcgacgcgggcgagttcagcctccccacgttcgactccctgaacatcaccgccgccagcctgaacgacgacggcctcgacaaccacaccatcctgctgtactactccaccgccgccagctccctggcggtgacgctcatgatcgccatcttcgtggtctacatggtgagccgcgacaacgtgtcctgcagcatctgcctg

SEQ ID NO: 13151 - RNA, 1758 nt, synthetic construct; identical to SEQ ID NO: 13150
  misc_feature 1..1758: note = derived and/or modified sequence opt1 from anti-influenza_Chain
  source 1..1758: mol_type = other RNA

SEQ ID NO: 13152 - RNA, 1749 nt, synthetic construct
  misc_feature 1..1749: note = derived and/or modified sequence opt1 from anti-influenza_Chain
  source 1..1749: mol_type = other RNA
atggaggcccgcctgctcgtgctgctgtgcgccttcgcggccaccaacgccgacaccatctgcatcggctaccacgccaacaacagcacggacaccgtcgacaccgtgctcgagaagaacgtgaccgtcacgcactccgtgaacctgctggaggacagccacaacgggaagctctgcaagctgaagggcatcgcgcccctgcagctcgggaagtgcaacatcgccggctggctgctggggaacccggagtgcgacctcctgctgaccgcctccagctggtcctacatcgtggagaccagcaactccgagaacgggacctgctaccccggcgacttcatcgactacgaggagctccgggagcagctgagctccgtcagctccttcgagaagttcgagatcttccccaagacgagctcctggcccaaccacgagaccaccaagggggtgaccgccgcctgcagctacgcgggcgcctccagcttctaccgcaacctgctctggctgacgaagaaggggtccagctacccgaagctgtccaagagctacgtgaacaacaagggcaaggaggtcctcgtgctgtggggcgtgcaccacccgcccaccggcaccgaccagcagagcctgtaccagaacgccgacgcctacgtctccgtgggcagctccaagtacaaccggcgcttcacccccgagatcgccgcgcggcccaaggtgcgcgaccaggccgggcggatgaactactactggacgctcctggagcccggcgacaccatcaccttcgaggccaccgggaacctgatcgccccctggtacgccttcgcgctcaaccgcggcagcggctccgggatcatcacgagcgacgcccccgtccacgactgcaacaccaagtgccagaccccgcacggcgccatcaactccagcctgcccttccagaacatccaccccgtgaccatcggggagtgccccaagtacgtgcggtccacgaagctgcgcatggccaccggcctccggaacatcccgagcatccagtcccgcgggctgttcggcgccatcgcgggcttcatcgagggcgggtggaccgggatgatcgacggctggtacgggtaccaccaccagaacgagcagggcagcggctacgccgccgaccagaagtccacccagaacgccatcgacgggatcacgaacaaggtcaacagcgtgatcgagaagatgaacacccagttcaccgccgtgggcaaggagttcaacaacctggagcggcgcatcgagaacctcaacaagaaggtcgacgacgggttcctggacatctggacctacaacgcggagctgctcgtgctgctggagaacgagcggacgctcgacttccacgactccaacgtgcgcaacctgtacgagaaggtcaagagccagctgaagaacaacgccaaggagatcggcaacgggtgcttcgagttctaccacaagtgcgacgacgcctgcatggagtccgtgcggaacggcacctacgactaccccaagtacagcgaggagtccaagctcaaccgcgaggagatcgacggcgtcaagctggagagcatgggggtgtaccagagcggccggctggtgccccgcgggtcccccggcagcggctacatcccggaggcgccccgggacgggcaggcctacgtccgcaaggacggcgagtgggtgctcctgtccaccttcctggggaagcccatccccaacccgctcctgggcctggacagcaccggg

SEQ ID NO: 13153 - RNA, 1749 nt, synthetic construct; identical to SEQ ID NO: 13152
  misc_feature 1..1749: note = derived and/or modified sequence opt1 from anti-influenza_Chain
  source 1..1749: mol_type = other RNA

SEQ ID NO: 13154 - RNA, 1755 nt, synthetic construct
  misc_feature 1..1755: note = derived and/or modified sequence opt1 from anti-influenza_Chain
  source 1..1755: mol_type = other RNA
atggagcgcaccgtgctgctcctggccaccgtcagcctggtgaagtccgaccagatctgcatcggctaccacgccaacaacagcacggagcaggtcgacaccatcatggagaagaacgtgaccgtgacccacgcgcaggacatcctcgagcggacgcacaacgggaagctgtgcgacctgaacggcgtgaagcccctcatcctgcgcgactgctccgtcgccgggtggctgctcggcaacccgatgtgcgacgagttcatcaacgtgcccgagtggagctacatcgtggagaaggcctcccccgccaacgacctgtgctaccccgggaacttcaacgactacgaggagctgaagcacctcctgagccggatcaaccacttcgagaagatccagatcatcccgaagtccagctggtccaaccacgacgccagctccggcgtcagctccgcgtgcccctacctgggccgcagctccttcttccggaacgtggtgtggctcatcaagaagaacagcgcctaccccaccatcaagcgctcctacaacaacaccaaccaggaggacctgctggtcctctggggcgtgcaccaccccaacgacgccgccgagcagaccaagctgtaccagaacccgacgacctacatcagcgtggggacctccaccctgaaccagcggctcgtccccgagatcgcgacgcgccccaaggtgaacgggcagagcggccggatggagttcttctggaccatcctgaagcccaacgacgccatcaacttcgagagcaacgggaacttcatcgccccggagtacgcctacaagatcgtgaagaagggcgactccaccatcatgaagtccgagctggagtacggcaactgcaacaccaagtgccagacgcccatgggggccatcaacagcagcatgcccttccacaacatccaccccctcaccatcggcgagtgcccgaagtacgtcaagtccaaccgcctggtgctggcgaccgggctccggaacacgccccagcgcgagcggcgccggaagaagcgcggcctgttcggcgccatcgccgggttcatcgagggcgggtggcagggcatggtggacgggtggtacggctaccaccacagcaacgagcagggctcctgctacagcgccgacaaggagtccacccagaaggccatcgacggggtcaccaacaaggtgaacagcatcatcaacaagatgaacacccagttcgaggcggtgggccgggagttcaacaacctggagcgccggatcgagaacctcaacaagaagatggaggacgggttcctggacgtctggacctacaacgccgagctgctcgtgctgatggagaacgagcgcacgctggacttccacgactccaacgtcaagaacctctacgacaaggtgcggctgcagctgcgcgacaacgccaaggagctcggcaacgggtgcttcgagttctaccacaagtgcgacaacgagtgcatggagagcgtgaagaacggcacctacgactacccccagtactccgaggaggcccgcctgaaccgggaggagatcagcggcgtcaagctggagtccatggggacctaccagagcggccgcctcgtgccccgggggtccccgggcagcgggtacatccccgaggcgccccgcgacggccaggcctacgtgcggaaggacggcgagtgggtcctgctgtccaccttcctcgggaagcccatcccgaaccccctgctgggcctcgacagcacgggg

SEQ ID NO: 13155 - RNA, 1755 nt, synthetic construct; identical to SEQ ID NO: 13154
  misc_feature 1..1755: note = derived and/or modified sequence opt1 from anti-influenza_Chain
  source 1..1755: mol_type = other RNA

SEQ ID NO: 13156 - RNA, 1947 nt, synthetic construct
  misc_feature 1..1947: note = derived and/or modified sequence opt1 from anti-influenza_Chain
  source 1..1947: mol_type = other RNA
atgggcgacaagatcaacttcatcttcgggatccacaaccaccagcccctgggcaacttcgggtgggtgttcgaggaggcctacgagaagtgctactggccgttcctcgagaccctggaggagtaccccaacatgaaggtcgccatccacaccagcggccccctgatcgagtggctccaggacaaccgccccgagtacatcgacctgctgcggtccctcgtgaagcgcggccaggtggagatcgtcgtggcggggttctacgagccggtgctggccagcatccccaaggaggaccggatcgagcagatccgcctgatgaaggagtgggccaagtccatcggcttcgacgcccgcggggtctggctcacggagcgggtgtggcagcccgagctggtgaagaccctgaaggagagcggcatcgactacgtcatcgtggacgactaccacttcatgtccgccgggctcagcaaggaggagctgtactggccctactacaccgaggacggcggggaggtgatcgcggtcttcccgatcgacgagaagctgcggtacctcatccccttccgccccgtggacaaggtgctggagtacctgcactccctcatcgacggcgacgagagcaaggtcgccgtgttccacgacgacggcgagaagttcgggatctggcccggcacctacgagtgggtgtacgagaaggggtggctgcgggagttcttcgaccgcatctccagcgacgagaagatcaacctgatgctctacacggagtacctggagaagtacaagccgcggggcctggtctacctccccatcgcctcctacttcgagatgagcgagtggtccctgcccgccaagcaggcgcgcctgttcgtggagttcgtgaacgagctcaaggtcaagggcatcttcgagaagtaccgggtgttcgtgcgcgggggcatctggaagaacttcttctacaagtaccccgagagcaactacatgcacaagcggatgctgatggtctccaagctggtgcgcaacaacccggaggcccggaagtacctcctgcgcgcccagtgcaacgacgcctactggcacgggctgttcggcggggtctacctcccccacctccggcgcgccatctggaacaacctgatcaaggcgaacagctacgtgtccctgggcaaggtgatccgggacatcgactacgacggcttcgaggaggtcctgatcgagaacgacaacttctacgccgtgttcaagcccagctacgggggctccctggtggagttcagcagcaagaaccgcctcgtcaactacgtggacgtgctggcccgccggtgggagcactaccacgggtacgtcgagtcccagttcgacggcgtggccagcatccacgagctggagaagaagatccccgacgagatccgcaaggaggtggcctacgacaagtaccggcgcttcatgctccaggaccacgtcgtgccgctggggaccaccctggaggacttcatgttctcccggcagcaggagatcggcgagttcccccgcgtgccctacagctacgagctcctggacggcgggatccggctgaagcgcgagcacctcggcatcgaggtcgagaagaccgtgaagctggtgaacgacgggttcgaggtcgagtacatcgtgaacaacaagacgggcaaccccgtgctgttcgcggtcgagctgaacgtggccgtgcagtccatcatggagagcccgggggtcctccggggcaaggagatcgtggtggacgacaagtacgccgtcggcaagttcgccctgaagttcgaggacgagatggaggtgtggaagtaccccgtgaagaccctgtcccagagcgagtccgggtgggacctcatccagcagggcgtcagctacatcgtgcccatccgcctggaggacaagatccggttcaagctgaagttcgaggaggcctccggg

SEQ ID NO: 13157 - RNA, 1947 nt, synthetic construct
  misc_feature 1..1947: note = derived and/or modified sequence opt1 from anti-influenza_Chain
  source 1..1947: mol_type = other RNA
atgagccgcatgaccctgaagtccagcatgaagaagcgggtgctctccctgctgatcgccgtcgtgttcctcagcctgaccggcgtgttcccctccgggctgatcgagacgaaggtcagcgccgcgaagatcaccgagaactaccagttcgactcccgcatccggctcaacagcatcggcttcatcccgaaccactccaagaaggccaccatcgccgccaactgcagcaccttctacgtggtgaaggaggacgggacgatcgtctacaccggcaccgccacctccatgttcgacaacgacacgaaggagaccgtgtacatcgcggacttcagctccgtgaacgaggaggggacctactacctggccgtccccggcgtgggcaagagcgtgaacttcaagatcgccatgaacgtctacgaggacgccttcaagaccgcgatgctggggatgtacctcctgcgctgcggcacgtccgtgagcgccacctacaacgggatccactactcccacggcccctgccacaccaacgacgcctacctggactacatcaacgggcagcacaccaagaaggacagcacgaagggctggcacgacgccggcgactacaacaagtacgtggtcaacgccgggatcaccgtgggctccatgttcctcgcgtgggagcacttcaaggaccagctggagcccgtggccctggagatcccggagaagaacaacagcatccccgacttcctcgacgagctgaagtacgagatcgactggatcctgaccatgcagtaccccgacgggagcggccgggtcgcccacaaggtgtccacccgcaacttcggcgggttcatcatgcccgagaacgagcacgacgagcggttcttcgtgccgtggagctccgccgccacggcggacttcgtcgccatgaccgccatggccgcccgcatcttccggccctacgacccccagtacgcggagaagtgcatcaacgccgccaaggtgagctacgagttcctcaagaacaaccccgccaacgtgttcgccaaccagtccggcttcagcaccggggagtacgcgaccgtctccgacgccgacgaccgcctgtgggccgccgcggagatgtgggagacgctgggcgacgaggagtacctccgggacttcgagaaccgcgccgcccagttcagcaagaagatcgaggccgacttcgactgggacaacgtggccaacctggggatgttcacctacctgctctccgagcggccgggcaagaaccccgcgctggtccagagcatcaaggactccctgctcagcaccgccgactccatcgtgcgcaccagccagaaccacggctacgggcggacgctgggcaccacctactactgggggtgcaacggcaccgtggtccgccagacgatgatcctccaggtggccaacaagatctcccccaacaacgactacgtgaacgccgccctggacgcgatcagccacgtcttcgggcggaactactacaaccgctcctacgtgaccggcctgggcatcaacccgcccatgaacccccacgaccggcgcagcggggccgacggcatctgggagccctggcccgggtacctggtgggcgggggctggccgggccccaaggactgggtcgacatccaggactcctaccagaccaacgagatcgccatcaactggaacgccgccctcatctacgcgctggccgggttcgtgaactacaacagcccccagaacgaggtgctgtacggcgacgtcaacgacgacgggaaggtgaacagcaccgacctcacgctgctgaagcggtacgtgctcaaggccgtctccaccctgcccagctccaaggccgagaagaacgcggacgtgaaccgcgacggccgcgtgaacagctccgacgtcaccatcctgagccggtacctcatccgcgtgatcgagaagctgccgatc

SEQ ID NO: 13158 - RNA, 1947 nt, synthetic construct; identical to SEQ ID NO: 13156
  misc_feature 1..1947: note = derived and/or modified sequence opt1 from anti-influenza_Chain
  source 1..1947: mol_type = other RNA

SEQ ID NO: 13159 - RNA, 1947 nt, synthetic construct; identical to SEQ ID NO: 13157
  misc_feature 1..1947: note = derived and/or modified sequence opt1 from anti-influenza_Chain
  source 1..1947: mol_type = other RNA

SEQ ID NO: 13160 - RNA, 2046 nt, synthetic construct
  misc_feature 1..2046: note = derived and/or modified sequence opt1 from anti-influenza_Chain
  source 1..2046: mol_type = other RNA
atgaagcccagccacttcaccgagaagcgcttcatgaagaaggtgctgggcctcttcctggtcgtggtgatgctggcctccgtcggggtgctcccgaccagcaaggtgcaggccgcgggcacgaccgtcacctccatggagtacttcagccccgccgacgggcccgtgatctccaagagcggcgtggggaaggcctcctacggcttcgtcatgcccaagttcaacggcgggagcgccacctggaacgacgtgtactccgacgtgggcgtcaacgtgaaggtggggaacaactgggtcgacatcgaccaggccggcgggtacatctacaaccagaactggggccactggagcgacggcgggttcaacggctactggttcacgctgtccgcgaccaccgagatccagctgtacagcaaggccaacggggtgaagctcgagtaccagctggtgttccagaacatcaacaagaccacgatcaccgccatgaacccgacccagggcccccagatcaccgcctccttcacgggcggggcgggcttcacctaccccaccttcaacaacgacagcgccgtcacctacgaggccgtggccgacgacctgaaggtgtacgtcaagcccgtgaactccagctcctggatcgacatcgacaacaacgccgcgagcgggtggatctacgaccacaacttcggccagttcacggacgggggcggcgggtactggttcaacgtgaccgagtccatcaacgtcaagctcgagagcaagaccagctccgccaacctggtgtacaccatcacgttcaacgagccgacccggaacagctacgtcatcaccccctacgagggcaccacgttcaccgccgacgccaacgggtccatcggcatccccctgcccaagatcgacgggggcgccccgatcgcgaaggagctcggcaacttcgtgtaccagatcaacatcaacgggcagtgggtggacctgagcaactccagccagtccaagttcgcctacagcgccaacggctacaacaacatgtccgacgccaaccagtgggggtactgggccgactacatctacggcctgtggttccagcccatccaggagaacatgcagatccgcatcgggtaccccctcaacggccaggcgggcgggaacatcggcaacaacttcgtcaactacaccttcatcgggaaccccaacgccccgcggcccgacgtgagcgaccaggaggacatctccatcggcacccccacggaccccgccatcgccggcatgaacctgatctggcaggacgagttcaacgggaccaccctggacaccagcaagtggaactacgagacgggctactacctcaacaacgacccggccacctgggggtggggcaacgcggagctgcagcactacaccaactccacccagaacgtgtacgtccaggacgggaagctgaacatcaaggccatgaacgacagcaagtccttcccccaggaccccaaccgctacgcccagtacagctccggcaagatcaacacgaaggacaagctcagcctgaagtacggccgggtggacttccgcgccaagctgcccaccggggacggcgtgtggccggcgctctggatgctgcccaaggactccgtctacgggacctgggccgccagcggcgagatcgacgtgatggaggcccgggggcgcctgcccggcagcgtgtccggcaccatccacttcgggggccagtggcccgtcaaccagagctccgggggcgactaccacttcccggaggggcagaccttcgccaacgactaccacgtgtacagcgtggtctgggaggaggacaacatcaagtggtacgtggacggcaagttcttctacaaggtgacgaaccagcagtggtactccaccgcggcccccaacaaccccaacgccccgttcgacgagcccttctacctcatcatgaacctggccgtcggcgggaacttcgacggcgggcggacccccaacgccagcgacatccccgcgaccatgcaggtcgactacgtgcgcgtgtacaaggagcag

SEQ ID NO: 13161 - RNA, 2046 nt, synthetic construct; identical to SEQ ID NO: 13160
  misc_feature 1..2046: note = derived and/or modified sequence opt1 from anti-influenza_Chain
  source 1..2046: mol_type = other RNA

SEQ ID NO: 13162 - RNA, 2058 nt, synthetic construct
  misc_feature 1..2058: note = derived and/or modified sequence opt1 from anti-influenza_Chain
  source 1..2058: mol_type = other RNA
atgaccaagagcatctacttctccctgggcatccacaaccaccagcccgtggggaacttcgacttcgtcatcgagcgcgcctacgagatgagctacaagccgctcatcaacttcttcttcaagcaccccgacttccccatcaacgtgcacttctccggcttcctgctgctctggctggagaagaaccaccccgagtacttcgagaagctgaagatcatggccgagcgggggcagatcgagttcgtgagcggcgggttctacgagccgatcctccccatcatccccgacaaggacaaggtccagcagatcaagaagctgaacaagtacatctacgacaagttcggccagacccccaagggcatgtggctggcggagcgcgtgtgggagccgcacctcgtgaagtacatcgccgaggccgggatcgagtacgtcgtggtggacgacgcccacttcttctccgtcggcctgaaggaggaggacctgttcgggtactacctcatggaggagcagggctacaagctggccgtgttccccatcagcatgaagctgcggtacctcatccccttcgcggaccccgaggagacgatcacctacctggacaagttcgcctccgaggacaagagcaagatcgccctgctgttcgacgacggggagaagttcggcctgtggccggacacctaccgcaccgtgtacgaggagggctggctggagacgttcgtctccaagatcaaggagaacttcctcctggtgacccccgtgaacctgtacacctacatgcagcgggtcaagcccaaggggcgcatctacctccccaccgccagctaccgggagatgatggagtgggtgctgttcccggaggcgcagaaggagctggaggagctcgtggagaagctgaagacggagaacctgtgggacaagttctccccctacgtcaagggcgggttctggcgcaacttcctcgccaagtacgacgagagcaaccacatgcagaagaagatgctgtacgtgtggaagaaggtgcaggactcccccaacgaggaggtcaaggagaaggccatggaggaggtgttccagggccaggccaacgacgcctactggcacggcatcttcgggggcctgtacctcccccacctccggaccgcgatctacgagcacctgatcaaggccgagaactacctcgagaacagcgagatccgcttcaacatcttcgacttcgactgcgacgggaacgacgagatcatcgtggagtccccgttcttcaacctgtacctgagccccaaccacggcgggtccgtcctcgagtgggacttcaagaccaaggccttcaacctgaccaacgtgctgacgcggcgcaaggaggcctaccacagcaagctctcctacgtcaccagcgaggcccagggcaagagcatccacgagcggtggaccgcgaaggaggagggcctggagaacatcctgttctacgacaaccaccgccgggtgtccttcaccgagaagatcttcgagagcgagcccgtgctcgaggacctgtggaaggactccagccgcctggaggtcgactccttctacgagaactacgactacgagatcaacaaggacgagaacaagatccgggtcctcttcagcggggtgttccgcggcttcgagctgtgcaagtcctacatcctgtacaaggacaagagcttcgtggacgtggtgtacgagatcaagaacgtctccgagacgcccatcagcctgaacttcgggtgggagatcaacctcaacttcctggccccgaaccaccccgactactacttcctgatcggcgaccagaagtaccccctctccagcttcgggatcgagaaggtgaacaactggaagatcttctccggcatcggcatcgagctggagtgcgtgctggacgtcgaggccagcctctaccggtaccccatcgagaccgtgtccctgagcgaggaggggttcgagcgcgtgtaccagggctccgccctgatccacttctacaaggtcgacctcccggtggggagcacctggcggaccacgatccgcttctgggtgaag

SEQ ID NO: 13163 - RNA, 2058 nt, synthetic construct; identical to SEQ ID NO: 13162
  misc_feature 1..2058: note = derived and/or modified sequence opt1 from anti-influenza_Chain
  source 1..2058: mol_type = other RNA

SEQ ID NO: 13164 - RNA, 2115 nt, synthetic construct
  misc_feature 1..2115: note = derived and/or modified sequence opt1 from anti-influenza_Chain
  source 1..2115: mol_type = other RNA
atgcccaccaacctgttcttcaacgcccaccacagcccggtgggcgccttcgcgtccttcaccctcgggttccccggcaagagcgggggcctggacctggagctcgcccgcccgccccggcagaacgtcctgatcggggtggagtccctgcacgagagcggcctctaccacgtgctgcccttcctggagacggccgaggaggacgagtccaagcgctacgacatcgagaaccccgaccccaacccccagaagccgaacatcctcatccccttcgccaaggaggagatccagcgggagttccacgtcgccaccgacacctggaaggcgggcgacctgaccttcacgatctacagccccgtgaaggccgtgcccaacccggagaccgccgacgaggaggagctgaagctcgccctggtccccgcggtgatcgtggagatgaccatcgacaacaccaacgggacgcgcgcccggcgcgccttcttcggcttcgaggggaccgacccctacacctccatgcggcgcatcgacgacacgtgcccccagctgcggggcgtcgggcagggccgcatcctcagcatcgtgtccaaggacgagggcgtgcggagcgccctgcacttctccatggaggacatcctgaccgcccagctcgaggagaactggaccttcgggctgggcaaggtcggggcgctgatcgtggacgtgccggccggcgagaagaagacctaccagttcgccgtctgcttctaccgcggcgggtacgtgaccgccggcatggacgccagctacttctacacgcggttcttccagaacatcgaggaggtggggctctacgcgctggagcaggccgaggtcctgaaggagcagtccttccgcagcaacaagctcatcgagaaggagtggctgtccgacgaccagaccttcatgatggcccacgccatccggagctactacggcaacacccagctgctcgagcacgaggggaagcccatctgggtggtgaacgagggcgagtaccgcatgatgaacaccttcgacctgacggtcgaccagctgttcttcgagctcaagctgaacccctggaccgtgaagaacgtgctggacctctacgtcgagcggtactcctacgaggaccgcgtgcggttccccggcgaggagaccgagtacccgagcgggatctccttcacccacgacatgggcgtcgccaacacgttcagccgcccccactacagctcctacgagctgtacgggatcagcggctgcttctcccacatgacccacgagcagctggtgaactgggtgctctgcgcggccgtctacatcgagcagaccaaggactgggcctggcgggacaagcgcctggccatcctggagcagtgcctcgagagcatggtgcgccgggaccaccccgaccccgagcagcgcaacggggtgatgggcctggactccacccggacgatgggcggggccgagatcaccacctacgacagcctggacgtctccctcggccaggcgcgcaacaacctgtacctggccgggaagtgctgggccgcctacgtggcgctcgagaagctgttccgggacgtgggcaaggaggagctggccgccctcgccggggagcaggccgagaagtgcgcggccaccatcgtcagccacgtgacggacgacggctacatcccggccatcatgggcgaggggaacgactccaagatcatccccgccatcgagggcctggtgttcccctacttcaccaactgccacgaggccctggacgagaacgggcgcttcggcgcgtacatccaggccctgcggaaccacctccagtacgtcctgcgcgagggcatctgcctgttccccgacgggggctggaagatcagctccaccagcaacaactcctggctcagcaagatctacctgtgccagttcatcgcccggcacatcctggggtgggagtgggacgagcagggcaagcgcgccgacgccgcgcacgtggcctggctcacccacccgacgctgtccatctggagctggtccgaccagatcatcgccggggagatcaccggcagcaagtactacccccggggcgtgacctccatcctgtggctcgaggagggggag

SEQ ID NO: 13165 - RNA, 2115 nt, synthetic construct; identical to SEQ ID NO: 13164
  misc_feature 1..2115: note = derived and/or modified sequence opt1 from anti-influenza_Chain
  source 1..2115: mol_type = other RNA

SEQ ID NO: 13166 - RNA, 2148 nt, synthetic construct
  misc_feature 1..2148: note = derived and/or modified sequence opt1 from anti-influenza_Chain
  source 1..2148: mol_type = other RNA
atggaggacttcgtgcgccagtgcttcaaccccatgatcgtcgagctggccgagaaggccatgaaggagtacggcgaggacctcaagatcgagaccaacaagttcgcggccatctgcacccacctggaggtgtgcttcatgtacagcgacttccacttcatcaacgagcagggggagtccatcatcgtggagccggaggaccccaacgccctgctcaagcaccggttcgagatcatcgagggccgcgaccggacgatggcctggaccgtcgtgaacagcatctgcaacaccaccggggccgagaagcccaagttcctgcccgacctgtacgactacaaggagaaccgcttcatcgagatcggcgtgacgcggcgcgaggtccacatctactacctcgagaaggcgaacaagatcaagtccgagaagacccacatccacatcttcagcttcaccggggaggagatggccaccaaggccgactacacgctggacgaggagtcccgggcccgcatcaagacccggctgttcaccatccgccaggagatggcgagccggggcctctgggactccttccgccagagcgagcggggcgaggagaccatcgaggagcgcttcgagatcacggggaccatgcggcgcctggccgaccagtccctgccgcccaacttcagctgcctcgagaacttccgggcctacgtggacggcttcgagcccaacgggtacatcgagggcaagctgtcccagatgagcaaggaggtgaacgcccgcatcgagcccttcctgcggaccaccccgcgccccatccggctccccgacgggcccccgtgcttccagcgctccaagttcctgctgatggacagcctcaagctgtccatcgaggaccccagccacgagggcgagggcatccccctgtacgacgccatcaagtgcatgcgcacgttcttcgggtggaaggagccctccgtcgtgaagccgcacggcaaggggatcaaccccaactacctcctgagctggaagcaggtcctggcggagctccaggacatcgagtccgaggagaagatcccccggaccaagaacatgaagaagaccagccagctgaagtgggccctgggcgagaacatggcccccgagaaggtggacttcgacgactgcaaggacatcagcgacctcaagcagtacgactccgacgagccggagctgcgcagcctgtccagctggatccagaacgagttcaacaaggcctgcgagctcaccgactccatctggatcgagctggacgagatcggcgaggacgtggcccccatcgagcacatcgcgagcatgcggcgcaactacttcacggccgaggtgtcccactgccgggccaccgagtacatcatgaagggggtctacatcaacaccgccctgctcaacgccagctgcgcggccatggacgacttccagctgatccccatgatctccaagtgccgcaccaaggagggccggcgcaagacgaacctgtacgggttcatcatcaagggccggagccacctccgcaacgacaccgacgtggtgaacttcgtctccatggagttcagcctgaccgacccccggctggagccgcacaagtgggagaagtactgcgtgctcgagatcggggacatgctgctgcgctccgccatcggccaggtgagccggcccatgttcctctacgtccgcaccaacggcacgtccaagatcaagatgaagtgggggatggagatgcggcgctgcctgctgcagagcctccagcagatcgagtccatgatcgaggccgagagctccgtgaaggagaaggacatgaccaaggagttcttcgagaaccggagcgagacctggcccatcggcgagagccccaagggggtggaggagggctccatcgggaaggtctgccgcaccctgctggccaagagcgtgttcaactccctctacgcgagcccgcagctggagggcttctccgccgagagccggaagctgctgctcatcgtccaggccctgcgcgacaacctggagcccggcacgttcgacctcgggggcctgtacgaggccatcgaggagtgcctgatcaacgacccctgggtgctcctgaacgcgtcctggttcaacagcttcctgacccacgccctccgc

SEQ ID NO: 13167 - RNA, 2148 nt, synthetic construct; identical to SEQ ID NO: 13166
  misc_feature 1..2148: note = derived and/or modified sequence opt1 from anti-influenza_Chain
  source 1..2148: mol_type = other RNA

SEQ ID NO: 13168 - RNA, 2256 nt, synthetic construct
  misc_feature 1..2256: note = derived and/or modified sequence opt1 from anti-influenza_Chain
  source 1..2256: mol_type = other RNA
atgaacatcaacccctacttcctgttcatcgacgtgccgatccaggccgccatcagcaccaccttcccctacacgggcgtcccgccctactcccacgggaccggcaccgggtacaccatcgacacggtgatccgcacccacgagtacagcaacaagggcaagcagtacatctccgacgtgaccgggtgcgtcatggtggacccgaccaacggccccctccccgaggacaacgagcccagcgcgtacgcccagctggactgcgtgctggaggccctcgaccggatggacgaggagcacccgggcctgttccaggccgggtcccagaacgccatggaggcgctgatggtcacgaccgtggacaagctcacccagggccgccagaccttcgactggacggtgtgccggaaccagcccgccgccaccgccctgaacaccaccatcacgagcttccgcctgaacgacctcaacggggcggacaagggcgggctggtccccttctgccaggacatcatcgactccctggacaagcccgagatgatcttcttcaccgtgaagaacatcaagaagaagctcccggccaagaaccggaagggcttcctgatcaagcgcatccccatgaaggtgaaggaccggatcacccgcgtcgagtacatcaagcgggccctgagcctcaacaccatgacgaaggacgccgagcgcggcaagctgaagcggcgcgccatcgcgaccgccgggatccagatccggggcttcgtgctggtggtcgagaacctcgccaagaacatctgcgagaacctggagcagtccgggctgcccgtgggcggcaacgagaagaaggccaagctcagcaacgccgtggcgaagatgctgtccaactgcccgcccgggggcatcagcatgaccgtcaccggggacaacacgaagtggaacgagtgcctgaacccccgcatcttcctcgccatgaccgagcggatcacccgcgactcccccatctggttccgggacttctgcagcatcgcccccgtgctgttctccaacaagatcgcccgcctgggcaaggggttcatgatcaccagcaagacgaagcggctcaaggcccagatcccctgccccgacctgttcaacatccccctggagcgctacaacgaggagacccgggcgaagctcaagaagctgaagcccttcttcaacgaggagggcaccgcctccctgagcccgggcatgatgatggggatgttcaacatgctctccaccgtgctgggcgtcgccgccctggggatcaagaacatcggcaacaaggagtacctctgggacgggctgcagagcagcgacgacttcgccctgttcgtgaacgcgaaggacgaggagacgtgcatggagggcatcaacgacttctaccggacctgcaagctcctgggcatcaacatgtccaagaagaagtcctactgcaacgagaccgggatgttcgagttcaccagcatgttctaccgcgacggcttcgtgagcaacttcgccatggagctgccctccttcggggtcgccggcgtgaacgagagcgccgacatggcgatcgggatgacgatcatcaagaacaacatgatcaacaacggcatgggccccgccaccgcccagaccgccatccagctgttcatcgccgactaccgctacacctacaagtgccaccgcggggactccaaggtcgagggcaagcggatgaagatcatcaaggagctctgggagaacaccaaggggcgcgacggcctgctcgtggcggacggcgggcccaacctgtacaacctgcggaacctccacatcccggagatcatcctgaagtacaacatcatggaccccgagtacaagggccgcctgctgcacccccagaacccgttcgtggggcacctcagcatcgagggcatcaaggaggccgacatcacgcccgcccacgggcccatcaagaagatggactacgacgccgtctccggcacccacagctggcggaccaagcgcaaccggtccatcctgaacaccgaccagcgcaacatgatcctggaggagcagtgctacgccaagtgctgcaacctcttcgaggcgtgcttcaacagcgcctcctaccggaagcccgtgggccagcacagcatgctggaggccatggcccaccgcctgcggatggacgcccgcctcgactacgagtccgggcggatgagcaaggaggacttcgagaaggcgatggcccacctgggcgagatcgggtacatg

SEQ ID NO: 13169 - RNA, 2256 nt, synthetic construct; identical to SEQ ID NO: 13168
  misc_feature 1..2256: note = derived and/or modified sequence opt1 from anti-influenza_Chain
  source 1..2256: mol_type = other RNA

SEQ ID NO: 13170 - RNA, 2265 nt, synthetic construct
  misc_feature 1..2265: note = derived and/or modified sequence opt1 from anti-influenza_Chain
  source 1..2265: mol_type = other RNA
atggccgtggacatcaagaagatcatcaagcagatgaccctggaggagaaggccggcctctgcagcgggctggacttctggcacaccaagcccgtcgagcgcctgggcatcccgtccatcatgatgacggacgggccccacggcctccggaagcagcgcgaggacgcggagatcgccgacatcaacaacagcgtgcccgcgacctgcttcccctccgccgccgggctggcctgcagctgggaccgggagctggtggagcgcgtcggcgccgccctcggcgaggagtgccaggccgagaacgtgtccatcctgctggggccgggcgcgaacatcaagcggagccccctctgcgggcgcaacttcgagtacttctccgaggacccctacctgagctccgagctggccgccagccacatcaagggcgtgcagtcccagggggtcggcgcctgcctcaagcacttcgccgcgaacaaccaggagcaccggcgcatgaccgtggacaccatcgtggacgagcggacgctgcgcgagatctacttcgccagcttcgagaacgccgtcaagaaggcccggccctgggtggtgatgtgcgcctacaacaagctgaacggcgagtactgctccgagaaccgctacctcctgaccgaggtcctgaagaacgagtggatgcacgacgggttcgtggtgagcgactggggcgcggtcaacgaccgggtgtccgggctcgacgccggcctggacctggagatgccgaccagccacggcatcaccgacaagaagatcgtggaggccgtcaagtccgggaagctcagcgagaacatcctgaaccgcgccgtggagcggatcctgaaggtgatcttcatggccctcgagaacaagaaggagaacgcgcagtacgacaaggacgcccaccaccgcctggcccggcaggccgccgcggagtccatggtcctgctcaagaacgaggacgacgtgctgcccctgaagaagtccggcacgatcgccctcatcggggccttcgtgaagaagccccgctaccagggcagcgggagcagccacatcacccccacccggctggacgacatctacgaggagatcaagaaggccggcggcgacaaggtcaacctggtgtactccgaggggtaccgcctcgagaacgacggcatcgacgaggagctgatcaacgaggcgaagaaggccgccagctccagcgacgtcgccgtggtgttcgccgggctgccggacgagtacgagtccgagggcttcgaccggacccacatgagcatccccgagaaccagaaccgcctcatcgaggcggtcgccgaggtgcagtccaacatcgtggtcgtgctgctgaacgggagccccgtggagatgccctggatcgacaaggtcaagtccgtgctcgaggcctacctgggcggccaggccctcgggggcgccctcgcggacgtgctgttcggggaggtcaacccgagcggcaagctggccgagacgttccccgtgaagctctcccacaaccccagctacctgaacttccccggggaggacgaccgcgtggagtacaaggagggcctgttcgtcggctaccggtactacgacaccaaggggatcgagccgctgttccccttcggccacgggctgtcctacaccaagttcgagtacagcgacatctccgtggacaagaaggacgtgagcgacaactccatcatcaacgtcagcgtgaaggtgaagaacgtcggcaagatggccggcaaggagatcgtgcagctgtacgtgaaggacgtcaagagctccgtgcgccggcccgagaaggagctgaaggggttcgagaaggtgttcctcaaccccggcgaggagaagaccgtcacgttcaccctggacaagcgcgccttcgcctactacaacacccagatcaaggactggcacgtggagagcggggagttcctgatcctcatcggccggtccagccgcgacatcgtgctgaaggagtccgtccgggtgaacagcaccgtgaagatccgcaagcggttcacggtcaactccgcggtggaggacgtgatgagcgactccagcgccgccgccgtcctggggccggtgctcaaggagatcaccgacgcgctgcagatcgacatggacaacgcccacgacatgatggccgccaacatcaagaacatgcccctgcgctccctcgtgggctacagccagggccggctgtccgaggagatgctggaggagctcgtcgacaagatcaacaacgtggag

SEQ ID NO: 13171 - RNA, 2265 nt, synthetic construct; identical to SEQ ID NO: 13170
  misc_feature 1..2265: note = derived and/or modified sequence opt1 from anti-influenza_Chain
  source 1..2265: mol_type = other RNA

SEQ ID NO: 13172 - RNA, 2277 nt, synthetic construct
  misc_feature 1..2277: note = derived and/or modified sequence opt1 from anti-influenza_Chain
  source 1..2277: mol_type = other RNA
atggagcgcatcaaggagctgcggaacctcatgagccagtcccgcacccgggagatcctgaccaagacgaccgtggaccacatggccatcatcaagaagtacaccagcggccgccaggagaagaaccccgccctgcggatgaagtggatgatggcgatgaagtacccgatcaccgccgacaagcgcatcacggagatgatccccgagcggaacgagcaggggcagaccctctggtccaagatgaacgacgccggcagcgaccgcgtcatggtgagccccctggccgtgacctggtggaaccggaacgggcccatgaccaacacggtccactacccgaagatctacaagacctacttcgagcgcgtggagcggctgaagcacggcaccttcgggcccgtgcacttccgcaaccaggtcaagatccggcgccgggtggacatcaaccccggccacgccgacctctccgcgaaggaggcccaggacgtgatcatggaggtcgtgttccccaacgaggtgggcgcccgcatcctgacctccgagagccagctgacgatcaccaaggagaagaaggaggagctccaggactgcaagatctccccgctgatggtcgcctacatgctggagcgggagctcgtgcgcaagacccggttcctgcccgtggccgggggcaccagctccgtctacatcgaggtgctgcacctcacgcaggggacctgctgggagcagatgtacacccccggcggggaggtgaagaacgacgacgtcgaccagagcctgatcatcgccgcccgcaacatcgtgcggcgcgccgccgtgtccgcggaccccctggccagcctcctggagatgtgccactccacccagatcggcggcatccgcatggtcgacatcctgaagcagaacccgacggaggagcaggccgtggggatctgcaaggccgccatgggcctccggatcagctccagcttctccttcgggggcttcaccttcaagcgcaccagcggcagctccgtgaagcgggaggaggaggtcctgaccgggaacctgcagacgctcaagatccgcgtgcacgagggctacgaggagttcaccatggtcgggcggcgcgcgaccgccatcctgcggaaggccacccgccggctgatccagctcatcgtgagcggccgcgacgagcagtccatcgccgaggccatcatcgtggcgatggtcttcagccaggaggactgcatgatcaaggccgtgcgcggggacctgaacttcgtgaaccgggccaaccagcggctgaaccccatgcaccagctcctgcgccacttccagaaggacgccaaggtcctgttccagaactggggcgtggagcccatcgacaacgtgatgggcatgatcgggatcctccccgacatgacgccgtccatcgagatgagcatgcggggcgtccgcatctccaagatgggggtggacgagtacagctccaccgagcgggtggtcgtgagcatcgaccgcttcctgcgggtgcgcgaccagcgcggcaacgtcctgctctcccccgaggaggtgagcgagacccaggggaccgagaagctgacgatcacctactccagctccatgatgtgggagatcaacggccccgagagcgtgctggtcaacacctaccagtggatcatccggaactgggagaccgtgaagatccagtggtcccagaaccccacgatgctctacaacaagatggagttcgagccgttccagagcctggtgcccaaggccatccgcggccagtactccgggttcgtccggaccctgttccagcagatgcgcgacgtgctcggcaccttcgacaccgcgcagatcatcaagctgctgcccttcgccgccgcgcccccgaagcagagccggatgcagttcagctccttcaccgtgaacgtccgcgggagcggcatgcggatcctcgtgcgcgggaactcccccgtgttcaactacaacaaggcgacgaagcggctgaccgtcctgggcaaggacgccggcaccctcaccgaggaccccgacgaggggacggccggcgtggagagcgccgtgctgcgcgggttcctgatcctgggcaaggaggaccggcgctacggccccgccctctccatcaacgagctgagcaacctggcgaagggggagaaggccaacgtcctcatcggccagggggacgtggtgctggtcatgaagcggaagcgcgactccagcatcctgaccgactcccagaccgccaccaagcggatccgcatggccatcaac

SEQ ID NO: 13173 - RNA, 2277 nt, synthetic construct; identical to SEQ ID NO: 13172
  misc_feature 1..2277: note = derived and/or modified sequence opt1 from anti-influenza_Chain
  source 1..2277: mol_type = other RNA

SEQ ID NO: 13174 - RNA, 2472 nt, synthetic construct
  misc_feature 1..2472: note = derived and/or modified sequence opt1 from anti-influenza_Chain
  source 1..2472: mol_type = other RNA
atgatgctgcgcaagaagaccaagcagctcatcagcagcatcctgatcctggtgctcctgctgagcctcttccccgccgccctggcggccgagggcaacacccgggaggacaacttcaagcacctcctggggaacgacaacgtcaagcgcccctccgaggccggcgccctgcagctgcaggaggtggacgggcagatgacgctcgtggaccagcacggcgagaagatccagctgcgggggatgagcacccacggcctgcagtggttccccgagatcctcaacgacaacgcctacaaggcgctgtccaacgactgggacagcaacatgatccgcctggccatgtacgtcggcgagaacgggtacgccaccaaccccgagctcatcaagcagcgggtgatcgacggcatcgagctggccatcgagaacgacatgtacgtgatcgtcgactggcacgtgcacgcgcccggggacccgcgcgaccccgtgtacgccggcgccaaggacttcttccgggagatcgccgccctgtaccccaacaacccccacatcatctacgagctcgcgaacgagccgtccagcaacaacaacgggggcgccggcatccccaacaacgaggaggggtggaaggccgtcaaggagtacgccgaccccatcgtggagatgctgcgcaagtccggcaacgccgacgacaacatcatcatcgtggggagccccaactggtcccagcggccggacctggcggccgacaaccccatcgacgaccaccacaccatgtacacggtccacttctacaccggcagccacgccgcctccaccgagagctacccctccgagacccccaacagcgagcgcggcaacgtgatgtccaacacgcggtacgccctcgagaacggggtggcggtcttcgccaccgagtggggcaccagccaggcctccggggacggcgggccgtacttcgacgaggccgacgtgtggatcgagttcctgaacgagaacaacatcagctgggccaactggagcctgaccaacaagaacgaggtgtccggcgcgttcacgcccttcgagctcggcaagagcaacgccaccaacctggaccccgggcccgaccacgtctgggccccggaggagctgtccctcagcggcgagtacgtgcgcgcccggatcaagggggtgaactacgagcccatcgaccgcaccaagtacaccaaggtcctgtgggacttcaacgacggcacgaagcaggggttcggcgtgaactccgacagccccaacaaggagctgatcgcggtggacaacgagaacaacaccctcaaggtctccggcctggacgtgagcaacgacgtctccgacgggaacttctgggccaacgcccggctgagcgccaacggctgggggaagtccgtggacatcctcggcgccgagaagctgaccatggacgtgatcgtcgacgagcccaccacggtggcgatcgccgccatcccgcagagctccaagagcgggtgggccaaccccgagcgcgccgtgcgggtcaacgcggaggacttcgtgcagcagaccgacggcaagtacaaggccggcctgaccatcaccggggaggacgcccccaacctcaagaacatcgccttccacgaggaggacaacaacatgaacaacatcatcctgttcgtgggcacggacgccgcggacgtcatctacctggacaacatcaaggtgatcgggaccgaggtggagatccccgtcgtgcacgacccgaagggcgaggccgtgctcccctccgtcttcgaggacggcacccgccaggggtgggactgggccggcgagagcggggtgaagaccgccctgacgatcgaggaggcgaacggctccaacgccctgagctgggagttcgggtaccccgaggtgaagccgtccgacaactgggccaccgcgccccggctcgacttctggaagtccgacctggtccgcggcgagaacgactacgtggccttcgacttctacctggaccccgtgcgggccaccgagggcgccatgaacatcaacctcgtcttccagcccccgaccaacgggtactgggtgcaggcccccaagacgtacaccatcaacttcgacgagctggaggaggccaaccaggtgaacggcctgtaccactacgaggtcaagatcaacgtgcgcgacatcaccaacatccaggacgacaccctgctccgcaacatgatgatcatcttcgccgacgtggagagcgacttcgcggggcgggtcttcgtggacaacgtgcgcttcgagggcgccgccacgaccgagcccgtcgagcccgagccggtggaccccggggaggagaccccgcccgtggacgagaaggaggccaagaaggagcagaaggaggccgagaaggaggagaaggaggcggtcaaggaggagaagaaggaggccaaggaggagaagaaggccgtgaagaacgaggccaagaagaag

SEQ ID NO: 13175 - RNA, 2472 nt, synthetic construct; identical to SEQ ID NO: 13174
  misc_feature 1..2472: note = derived and/or modified sequence opt1 from anti-influenza_Chain
  source 1..2472: mol_type = other RNA

SEQ ID NO: 13176 - RNA, 3063 nt, synthetic construct
  misc_feature 1..3063: note = derived and/or modified sequence opt1 from anti-influenza_Chain
  source 1..3063: mol_type = other RNA
atggccggcccccaccgcagccgggccgcggggccgccgcccttcgccgtggacgagcacgtcgccctggagatggtggccttccgcggcgaggtgttcgccgggcacggcctcctggcggaccagcggctgatcgcccacaccgggcgccccgccctcaacgcccagcggatcacccagcagaagcagcgcgaccagtgccggggccagcgccaccggcaccaccagggcgggcgcaacctgcggaaggcgcaccgcacgttccacgagcaccagtccacccaggaccaggcccacgacgcgccccacggccagcaggccaagaccgggcacgagggcctggggcacgagcacgcccaggcccagcaccagcagggccagagcaacgtcgtggaccggcaggacggcgagcccgtggaggcccagcaccagaaggacggggcccagcgcgccggcaacgcccccgcggggcgggtcgagctcgagcagcagcccgtggaggcccagcaccagcagcaggagggcgacgtgcgcatcggcaagcggcgccagaacgccttcgccccgcccgccctggaccacgtccacgggggccccgggcggctgcagcgccacggcctcgcggtggagcggcacgtgcccgccgtccagcagcaccagcagcgcgtgcagcgcgggcggcagcagatcgaccacgtgctgggccacggcctgccggggcgccagcggctcgccttccgcgacggcccccggcgccccgtcggggtggcctcccccgtgctgggccagcggccgtgccccgggcaccgcatcgtccagaacctgttccggcacggcatcgacccctgccgcgtgggccggtgccgccggagcccctccgagctccacgggatgggctgcgccgacgtgcgcgcgcgggggcacggccgccacatgcgggggcagcgcgacgagcacccgggccggggccgcccctgcgcccgccggcgccacgtcgacgacgaccgggaccgcacgccccaggagaagctgtacgacgtggcccgggggctggacgagcccgcccgccgggtgcacttcgacgacgaggcggaccgcagcgtcttccggggcctcgcccagccggcccccgacgagcccgaggggcgccggcgcgaccggctggtgctgcagcgccagtccgtcaaccaccggcgcggccggctcagccgccaccggcagcagcaccagccccagcagcagcgcccgcacggcaaccaggccttcctggggaagtacgagaagcggcgccgcaagcccaccgcctgcctgaagtccctccggcgcttccccgacaaggacgcgccggtgctgtacttcgtgaaccagctggagaagaccaagcggcgcatgaccctcctgctggtctggctcatcttcaccggcgtggccggggagatccggctggaggccgaggacggcgagctgctcggggtggccgtcgacagcacgctgaccggctactccggccgcgggtacgtgaccggcttcgacgcccccgaggacagcgtgcggttctccttcgaggcgccccgcggggtctaccgggtggtgttcggcgtcagcttctccagccgcttcgcctcctacgccctgcgggtggacgactggcaccagaccgggagcctcatcaagcgcggcggcgggttcttcgaggcctccatcggcgagatctggctggacgagggggcccacacgatggcgttccagctgatgaacggcgccctcgactacgtgcggctggagcccgtcagctacgggccgcccgcccgcccgcccgcccagctgagcgactcccaggcgaccgccagcgcccaggccctcttcgccttcctgctgtccgagtacggccggcacatcctcgcgggccagcagcagaacccctaccgccgggacttcgacgccatcaactacgtgcgcaacgtgaccgggaaggagcccgccctggtcagcttcgacctgatcgactactcccccacccgggaggcccacggcgtggtgcactaccagacgcccgaggactggatcgcctgggcggggcgcgacggcatcgtcagcctcatgtggcactggaacgccccgaccgacctgatcgaggacccctcccaggactgctactggtggtacgggttctacacccgctgcaccacgttcgacgtggccgccgccctggcggacaccagctccgagcggtaccgcctgctcctgcgggacatcgacgtgatcgccgcccagctgcagaagttccagcaggccgacatccccgtcctctggcgccccctgcacgaggcggccggcggctggttctggtggggcgccaaggggccggagcccttcaagcagctgtggcggctcctgtacgagcgcctggtgcaccaccacgggctccacaacctgatctgggtgtacacccacgagcccggcgccgccgagtggtaccccggcgacgcgtacgtcgacatcgtggggcgggacgtgtacgccgacgacccggacgccctgatgcgcagcgactggaacgagctccagaccctgttcggcgggcggaagctggtcgccctcacggagaccggcaccctgcccgacgtggaggtgatcaccgactacgggatctggtggtcctggttcagcatctggacggaccccttcctgcgcgacgtcgaccccgaccggctcacccgcgtgtaccactccgagcgggtgctgacccgcgacgagctgccggactggcggagctacgtcctccacgccaccacggtgcagcccgcgggcgacctggccctggccgtgtaccccaacccgggcgccgggcgcctccacgtcgaggtgggcctgcccgtggccgcgcccgtcgtggtggaggtcttcaacctgctcgggcagcgggtgttccagtaccaggccggcatgcagcccgccgggctgtggcgccgggccttcgagctggccctcgcgccgggcgtgtacctggtccaggtgcgcgccggcaacctggtggcccggcgccgctgggtctccgtgcgg

SEQ ID NO: 13177 - RNA, 3063 nt, synthetic construct; identical to SEQ ID NO: 13176
  misc_feature 1..3063: note = derived and/or modified sequence opt1 from anti-influenza_Chain
  source 1..3063: mol_type = other RNA

SEQ ID NO: 13178 - RNA, 3165 nt, synthetic construct
  misc_feature 1..3165: note = derived and/or modified sequence opt1 from anti-influenza_Chain
  source 1..3165: mol_type = other RNA
atgcgcaagaagcggcgcggcttcctgaacgccagcaccgccgtgctcgtcgggatcctggcgggcttcctgggggtggtgctcgccgccaccggcgccctggggttcgccgtccgggagtccctgctcctgaagcagttcctgttcctcagcttcgagggcaacacggacggcgcgtcccccttcgggaaggacgtggtggtcaccgccagccaggacgtggccgccgacggcgagtactccctgaaggtggagaaccgcaccagcgtctgggacggggtggagatcgacctgaccggcaaggtgaacacggggaccgactacctcctgtccttccacgtctaccagaccagcgactccccgcagctgttcagcgtgctcgcgcggaccgaggacgagaagggcgagcgctacaagatcctggccgacaaggtggtcgtgcccaactactggaaggagatcctggtgcccttctcccccacgttcgagggcaccccggccaagttcagcctcatcatcacctcccccaagaagaccgacttcgtcttctacgtggacaacgtgcaggtcctgacgcccaaggaggccgggcccaaggtggtgtacgagaccagcttcgagaagggcatcggggactggcagccgcggggctccgacgtcaagatcagcatctcccccaaggtggcccacagcggcaagaagtccctgttcgtcagcaaccgccagaaggggtggcacggcgcgcagatcagcctcaaggggatcctgaagaccggcaagacctacgccttcgaggcctgggtgtaccaggagtccgggcaggaccagacgatcatcatgaccatgcagcggaagtacagctccgacagctccaccaagtacgagtggatcaaggccgccaccgtgcccagcggccagtgggtccagctgtccggcacgtacaccatccccgcgggggtgaccgtggaggacctcaccctgtacttcgagagccagaacccgacgctggagttctacgtcgacgacgtgaaggtggtcgacaccacctccgccgagatcaagctcgagatgaaccccgaggaggagatccccgccctgaaggacgtgctgaaggactacttccgcgtgggcgtcgccctccccagcaaggtgttcatcaaccagaaggacatcgccctgatctccaagcacagcaactccagcaccgcggagaacgagatgaagccggactccctgctcgccgggatcgagaacggcaagctgaagttccggttcgagacggccgacaagtacatcgagttcgcccagcagaacgggatggtggtccgcggccacaccctggtgtggcacaaccagacccccgagtggttcttcaaggacgagaacggcaacctcctgagcaaggaggagatgaccgagcggctgcgcgagtacatccacacggtggtcgggcacttcaagggcaaggtgtacgcctgggacgtggtcaacgaggcggtggaccccaaccagcccgacgggctccggcgctccacctggtaccagatcatgggcccggactacatcgagctggccttcaagttcgcccgggaggccgaccccaacgcgaagctgttctacaacgactacaacaccttcgagcccaagaagcgcgacatcatctacaacctcgtcaagagcctgaaggagaaggggctgatcgacggcatcggcatgcagtgccacatctccctcgccaccgacatccggcagatcgaggaggccatcaagaagttcagcacgatccccgggatcgagatccacatcaccgagctggacatcagcgtgtaccgcgactccaccagcaactactccgaggccccgcggaccgccctgatcgagcaggcgcacaagatggcccagctgttcaagatcttcaagaagtacagcaacgtgatcaccaacgtgacgttctggggcctcaaggacgactactcctggcgcgccacccgccggaacgactggcccctgatcttcgacaaggactaccaggccaagctggcctactgggcgatcgtcgcccccgaggtgctgcccccgctccccaaggagagcaagatctccgagggggaggccgtggtcgtgggcatgatggacgacagctacatgatgtccaagcccatcgagatctacgacgaggagggcaacgtgaaggccaccatccgcgccatctggaaggacagcaccatctacgtctacggggaggtgcaggacgcgacgaagaagccggccgaggacggcgtggccatcttcatcaaccccaacaacgagcggaccccctacctgcagcccgacgacacctacgtcgtgctctggaccaactggaagtccgaggtgaaccgcgaggacgtcgaggtgaagaagttcgtggggccgggcttccggcgctacagcttcgagatgtccatcacgatccccggggtcgagttcaagaaggacagctacatcggcttcgacgtggccgtgatcgacgacggcaagtggtactcctggagcgacaccaccaactcccagaagaccaacacgatgaactacgggaccctgaagctggagggcgtcatggtggcgaccgccaagtacgggacccccgtgatcgacggcgagatcgacgacatctggaacacgaccgaggagatcgagaccaagagcgtcgccatggggagcctcgagaagaacgccaccgccaaggtgcgggtgctgtgggacgaggagaacctgtacgtcctcgcgatcgtgaaggaccccgtcctgaacaaggacaactccaacccgtgggagcaggacagcgtggagatcttcatcgacgagaacaaccacaagacgggctactacgaggacgacgacgcccagttccgcgtgaactacatgaacgagcagtccttcggcaccggggccagcgccgcccggttcaagaccgcggtcaagctgatcgagggcgggtacatcgtggaggccgccatcaagtggaagaccatcaagccctcccccaacacggtgatcggcttcaacgtccaggtgaacgacgccaacgagaaggggcagcgcgtgggcatcatcagctggtccgaccccaccaacaacagctggcgggacccgtccaagttcggcaacctccgcctgatcaag

SEQ ID NO: 13179 - RNA, 3165 nt, synthetic construct; identical to SEQ ID NO: 13178
  misc_feature 1..3165: note = derived and/or modified sequence opt1 from anti-influenza_Chain
  source 1..3165: mol_type = other RNA

SEQ ID NO: 13180 - RNA, 3177 nt, synthetic construct
  misc_feature 1..3177: note = derived and/or modified sequence opt1 from anti-influenza_Chain
  source 1..3177: mol_type = other RNA
atgcaggtccgcaagcggcgcggcctgctcgacgtgagcaccgccgtgctggtggggatcctggccggcttcctcggggtcgtgctggcggcctccggcgtgctgagcttcgggaaggaggcctccagcaagggcgactccagcctcgagaccgtcctggccctgtccttcgagggcacgaccgagggggtggtgcccttcggcaaggacgtcgtgctcaccgccagccaggacgtggcggccgacggggagtactccctgaaggtcgagaaccggaccagcccgtgggacggcgtggagatcgacctgacggggaaggtgaagtccggcgccgactacctcctgagcttccaggtctaccagtccagcgacgcgccccagctgttcaacgtggtggcccgcaccgaggacgagaagggcgagcggtacgacgtcatcctcgacaaggtggtggtctccgaccactggaaggagatcctggtgcccttcagccccaccttcgaggggaccccggccaagtactccctgatcatcgtggccagcaagaacacgaacttcaacttctacctcgacaaggtccaggtgctggcccccaaggagtccggccccaaggtcatctacgagaccagcttcgagaacggggtgggcgactggcagccccgcggcgacgtgaacatcgaggccagctccgaggtcgcgcacagcgggaagtccagcctgttcatctccaaccggcagaagggctggcagggggcccagatcaacctcaagggcatcctgaagaccgggaagacctacgccttcgaggcctgggtgtaccagaacagcggccaggaccagacgatcatcatgaccatgcagcgcaagtactccagcgacgcctccacccagtacgagtggatcaagagcgcgaccgtgccgtccggccagtgggtccagctgagcgggacgtacaccatccccgccggcgtgaccgtggaggacctcaccctgtacttcgagtcccagaaccccacgctggagttctacgtcgacgacgtgaagatcgtggacaccaccagcgccgagatcaagatcgagatggagcccgagaaggagatcccggccctcaaggaggtcctgaaggactacttcaaggtgggggtggccctgccctccaaggtcttcctcaaccccaaggacatcgagctgatcaccaagcacttcaacagcatcacggcggagaacgagatgaagcccgagtccctgctcgccggcatcgagaacgggaagctgaagttccggttcgagaccgccgacaagtacatccagttcgtggaggagaacggcatggtgatccgcggccacaccctggtctggcacaaccagaccccggactggttcttcaaggacgagaacgggaacctcctgagcaaggaggccatgacggagcggctgaaggagtacatccacaccgtggtgggccacttcaaggggaaggtctacgcctgggacgtggtgaacgaggcggtcgaccccaaccagcccgacggcctccgccggtccacctggtaccagatcatggggcccgactacatcgagctggccttcaagttcgcccgcgaggccgacccggacgcgaagctgttctacaacgactacaacaccttcgagccccggaagcgcgacatcatctacaacctcgtgaaggacctgaaggagaagggcctgatcgacggcatcgggatgcagtgccacatcagcctcgccacggacatcaagcagatcgaggaggccatcaagaagttcagcaccatccccggcatcgagatccacatcaccgagctggacatgtccgtgtaccgggacagctccagcaactaccccgaggccccgcgcaccgccctgatcgagcaggcgcacaagatgatgcagctgttcgagatcttcaagaagtactccaacgtcatcacgaacgtgaccttctgggggctcaaggacgactacagctggcgggccacccgccggaacgactggcccctgatcttcgacaaggaccaccaggccaagctggcctactgggccatcgtggcgcccgaggtcctgcccccgctccccaaggagtcccgcatcagcgagggcgaggccgtggtggtcggcatgatggacgactcctacctgatgagcaagcccatcgagatcctcgacgaggaggggaacgtgaaggccaccatccgcgccgtgtggaaggactccaccatctacatctacggcgaggtccaggacaagacgaagaagccggccgaggacggggtggcgatcttcatcaaccccaacaacgagcggaccccctacctgcagcccgacgacacctacgccgtgctgtggaccaactggaagacggaggtcaaccgcgaggacgtccaggtgaagaagttcgtgggcccggggttccggcgctacagcttcgagatgtccatcaccatccccggcgtggagttcaagaaggacagctacatcggcttcgacgccgccgtgatcgacgacgggaagtggtactcctggagcgacaccaccaactcccagaagacgaacaccatgaactacggcaccctcaagctggaggggatcatggtcgcgaccgccaagtacggcacgcccgtgatcgacggggagatcgacgagatctggaacaccaccgaggagatcgagaccaaggccgtggccatgggcagcctggacaagaacgccacggcgaaggtccgggtgctctgggacgagaactacctgtacgtgctggccatcgtcaaggaccccgtgctcaacaaggacaacagcaacccgtgggagcaggactccgtcgagatcttcatcgacgagaacaaccacaagaccggctactacgaggacgacgacgcccagttccgcgtgaactacatgaacgagcagaccttcgggaccggcgggagccccgcccggttcaagacggccgtgaagctgatcgagggcgggtacatcgtcgaggcggccatcaagtggaagaccatcaagcccacccccaacaccgtgatcggcttcaacatccaggtgaacgacgccaacgagaagggccagcgcgtcgggatcatctcctggagcgacccgacgaacaactcctggcgggaccccagcaagttcggcaacctgcgcctcatcaag

SEQ ID NO: 13181 - RNA, 3177 nt, synthetic construct; identical to SEQ ID NO: 13180
  misc_feature 1..3177: note = derived and/or modified sequence opt1 from anti-influenza_Chain
  source 1..3177: mol_type = other RNA

SEQ ID NO: 13182 - RNA, 318 nt, synthetic construct
  misc_feature 1..318: note = derived and/or modified sequence opt1 from anti-OX40_LightChain
  source 1..318: mol_type = other RNA
gagatcgtggtcacccagagccccgccaccctgtccctcagcccgggcgagcgcgccacgctgtcctgccgggcgagccagtccgtgagctcctacctggcctggtaccagcagaagcccgggcaggcgccccgcctcctgatctacgacgccagcaaccgggccaccggcatccccgcccgcttctccgggagcggctccgggaccgacttcaccctgacgatcagctccctcgagccggaggacttcgccgtgtactactgccagcagcggagcaactggcccaccttcggccagggcaccaaggtcgagatcaag

SEQ ID NO: 13183 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgcccaccttcggcggcgggaccaaggtggagatcaag

SEQ ID NO: 13184 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggccacaccctcccgcccaccttcggccaggggacgaaggtggagatcaag

SEQ ID NO: 13185 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctctccgccagcgtgggcgaccgcgtcaccatcacgtgccgggcctcccaggacatcagcaactacctcaactggtaccagcagaagccggggaagaccgtgaagctgctgatctactacacctcccgcctccggagcggcgtgccctcccgcttcagcgggtccggcagcgggaccgacttcacgctgaccatctccagcctgcagcccgaggacttcgcgacctactactgccagcagggccacaccctgcccccgacgttcggccaggggaccaaggtcgagatcaag

SEQ ID NO: 13186 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctctccgccagcgtgggcgaccgcgtcaccatcacgtgccgggcctcccaggacatcagcaactacctcaactggtaccagcagaagccggggaagaccgtgaagctgctgatctactacacctcccgcctccggagcggcgtgccctcccgcttcagcgggtccggcagcgggaaggactacaccctgacgatctccagcctgcagcccgaggacttcgcgacctacttctgccagcagggccacaccctgcccccgaccttcggccaggggacgaaggtcgagatcaag

SEQ ID NO: 13187 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggccacaccctcccggccaccttcggccaggggacgaaggtggagatcaag

SEQ ID NO: 13188 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggccacaccgccccgcccaccttcggccaggggacgaaggtggagatcaag

SEQ ID NO: 13189 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggcgccaccctcccgcccaccttcggccaggggacgaaggtggagatcaag

SEQ ID NO: 13190 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggccacgccctcccgcccaccttcggccaggggaccaaggtggagatcaag

SEQ ID NO: 13191 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcaggcccacaccctcccgcccaccttcggccagggcacgaaggtggagatcaag

SEQ ID NO: 13192 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggccacaccctcgccccgaccttcggccaggggacgaaggtggagatcaag

SEQ ID NO: 13193 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccaggccggccacaccctcccgcccaccttcggccaggggacgaaggtggagatcaag

SEQ ID NO: 13194 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctccaagctccacagcggcgtgccctcccgcttcagcgggtccggcagcgggaccgactacaccctgacgatctccagcctgcagcccgaggacttcgccacctactactgccagcagggctccgccctcccgtggaccttcggccaggggaccaaggtggagatcaag

SEQ ID NO: 13195 - RNA, 321 nt, synthetic construct
  misc_feature 1..321: note = derived and/or modified sequence opt1 from anti-OX40_LightChain
  source 1..321: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcggtgaagctgctgatctactacacctccaagctccacagcggcgtgccctcccgcttcagcgggtccggcagccggaccgactacaccctgacgatctccagcctgcagcccgaggacttcgccacctactactgccagcaggggtccgccctcccctggaccttcggccagggcaccaaggtcgagatcaag

SEQ ID NO: 13196 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgtgctggcgccccggtggtacttctccgtgtggggccaggggaccctggtcaccgtgagctcc

SEQ ID NO: 13197 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacagctacatgtcctgggtgcgccaggccccggggcagggcctcgagtggatcggggacatgtaccccgacaacggcgacagctcctacaaccagaagttccgggagcgcgtgacgatcaccgtcgacaccagcacctccacggcctacctggagctgagctccctccggagcgaggacaccgccgtgtactactgcgtgctggcgccccgctggtacttctccgtctggggccaggggaccctggtgaccgtgagctcc

SEQ ID NO: 13198 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacagctacatgtcctgggtgcgccaggccccggggcagggcctcgagtggatcggggacatgtaccccgacaacggcgacagctcctacaaccagaagttccgggagcgcgtgacgctgaccgtcgacaccagcacctccacggcctacctggagctcagctccctgcggagcgaggacaccgccgtgtactactgcgtgctggcgccccgctggtacttctccgtctggggccaggggaccctcgtgaccgtgagctcc

SEQ ID NO: 13199 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacgcctacatgagctgggtgcgccaggccccggggcagggcctcgagtggatcggggacatgtaccccgacaacggcgactccagctacaaccagaagttccgggagcgcgtgacgatcacccgggacacctccaccagcacggcctacctggagctgtccagcctccgctccgaggacaccgccgtctactactgcgtgctggcgccccggtggtacttcagcgtgtggggccaggggaccctggtcaccgtgtccagc

SEQ ID NO: 13200 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgagagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgtgctggcgccccggtggtacttctccgtgtggggccaggggaccctggtcaccgtgagctcc

SEQ ID NO: 13201 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacgccgacagctcctacaaccagaagttccgggagcgcgtgacgatcacccgggacaccagcacctccacggcctacctggagctgagctccctccgcagcgaggacaccgccgtctactactgcgtgctggcgccccggtggtacttctccgtgtggggccagggcaccctggtcaccgtgagctcc

SEQ ID NO: 13202 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacagctacatgtcctgggtgcgccaggccccggggcagggcctcgagtggatcggggacatgtaccccgacaacgccgacgccagctacaaccagaagttccgggagcgcgtgacgatcacccgggacacctccaccagcacggcctacctggagctgtccagcctccgctccgaggacaccgcggtctactactgcgtgctggcgccccggtggtacttcagcgtgtggggccagggcaccctggtcaccgtgtccagc

SEQ ID NO: 13203 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacggcgacgccagctacaaccagaagttccgggagcgcgtgacgatcacccgggacacctccaccagcacggcctacctggagctgtccagcctccgctccgaggacaccgccgtctactactgcgtgctggcgccccggtggtacttcagcgtgtggggccaggggaccctggtcaccgtgtccagc

SEQ ID NO: 13204 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacagctacatgtcctgggtgcgccaggccccggggcagggcctcgagtggatcggggacatgtaccccgacagcggcgactccagctacaaccagaagttccgggagcgcgtgacgatcacccgggacacctccaccagcacggcctacctggagctgtccagcctccgctccgaggacaccgccgtctactactgcgtgctggcgccccggtggtacttcagcgtgtggggccaggggaccctggtcaccgtgtccagc

SEQ ID NO: 13205 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacagctacatgtcctgggtgcgccaggccccggggcagggcctcgagtggatcggggacatgtaccccgacaacggcagctccagctacaaccagaagttccgggagcgcgtgacgatcacccgggacacctccaccagcacggcctacctggagctgtccagcctccgctccgaggacaccgccgtctactactgcgtgctggcgccccggtggtacttcagcgtgtggggccaggggaccctggtcaccgtgtccagc

SEQ ID NO: 13206 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcctccggctacaccttcaccgacgcctacatgagctgggtgcgccaggccccggggcagggcctcgagtggatcggggacatgtaccccgacaacgccgacgcctcctacaaccagaagttccgggagcgcgtgacgatcacccgggacaccagcacctccacggcgtacctggagctgagctccctccgcagcgaggacaccgccgtctactactgcgtgctggcgccccggtggtacttctccgtgtggggccagggcaccctggtcaccgtgagctcc

SEQ ID NO: 13207 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgtgctggcgccccggtggtacttctccgcctggggccaggggaccctggtgaccgtcagctcc

SEQ ID NO: 13208 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgtgctggcgccccggtggtacttcgccgtgtggggccaggggaccctggtcaccgtgtccagc

SEQ ID NO: 13209 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgccctggcgccccggtggtacttctccgtgtggggccaggggaccctggtgaccgtcagctcc

SEQ ID NO: 13210 - RNA, 351 nt, synthetic construct
  misc_feature 1..351: note = derived and/or modified sequence opt1 from anti-OX40_HeavyChain
  source 1..351: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgtggccgcgccccggtggtacttctccgtgtggggccaggggaccctggtcaccgtgagctcc

SEQ ID NO: 13211 - RNA, 354 nt, synthetic construct
  misc_feature 1..354: note = derived and/or modified sequence opt1 from anti-OX40_HeavyChain
  source 1..354: mol_type = other RNA
gaggtgcagctggtcgagagcggcgggggcctcgtgcagcccgggggctccctgcgcctgagctgcgccgcctccgggttcaccttcagctcctacagcatgaactgggtgcggcaggcgccgggcaagggcctcgagtgggtctcctacatcagctccagctccagcaccatcgactacgccgactccgtgaaggggcgcttcacgatcagccgggacaacgccaagaactccctgtacctgcagatgaacagcctccgcgacgaggacaccgccgtgtactactgcgcccgggagtccggctggtacctgttcgactactgggggcagggcaccctggtcaccgtgagctcc

SEQ ID NO: 13212 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgccagcaccccgggaagggcctcgagtggatcggctacatcagctacaacgggatcacgtaccacaacccctccctcaagagccggatcaccatcaaccccgacacctccaagaaccagttcagcctgcagctgaactccgtgaccccggaggacacggccgtctactactgcgcgcgctaccggtacgactacgacggcgggcacgccatggactactggggccaggggaccctggtgaccgtgagctcc

SEQ ID NO: 13213 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtggatcggctacatcagctacaacgggatcacgtaccacaacccctccctcaagagccggatcaccatcaaccgcgacacctccaagaaccagttcagcctgcagctgaactccgtgacccccgaggacacggccgtctactactgcgcgcggtaccgctacgactacgacggcgggcacgccatggactactggggccaggggaccctggtgaccgtgagctcc

SEQ ID NO: 13214 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgactccttcagctccgggtactggaactggatccgcaagcaccccggcaaggggctcgagtacatgggctacatcagctacaacggcatcacgtaccacaacccctccctcaagagccggatcaccatcaaccgcgacacctccaagaaccagtacagcctgcagctgaactccgtgacccccgaggacacggccgtctacttctgcgcgcggtaccgctacgactacgacgggggccacgccatggactactgggggcagggcaccctggtgaccgtgagctcc

SEQ ID NO: 13215 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgactccttcagctccgggtactggaactggatccgcaagcaccccggcaaggggctcgagtacatcggctacatcagctacaacggcatcacgtaccacaacccctccctcaagagccggatcaccatcaaccgcgacacctccaagaaccagtacagcctgcagctgaactccgtgacccccgaggacacggccgtctacttctgcgcgcggtaccgctacgactacgacgggggccacgccatggactactgggggcagggcaccctggtgaccgtgagctcc

SEQ ID NO: 13216 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgactccttcagctccgggtactggaactggatccgcaagcaccccggcaaggggctcgagtacatcggctacatcagctacaacggcatcacgtaccacaacccctccctcaagagccggatcaccatcaaccgcgacacctccaagaaccagttcagcctgcagctgaactccgtgacccccgaggacacggccgtctacttctgcgcgcggtaccgctacgactacgacgggggccacgccatggactactgggggcagggcaccctggtgaccgtgagctcc

SEQ ID NO: 13217 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgactccttcagctccgggtactggaactggatccgcaagcaccccggcaaggggctcgagtacatcggctacatcagctacaacggcatcacgtaccacaacccctccctcaagagccggatcaccatcaaccgcgacacctccaagaaccagtacagcctgcagctgaactccgtgacccccgaggacacggccgtctactactgcgcgcggtaccgctacgactacgacgggggccacgccatggactactgggggcagggcaccctggtgaccgtgagctcc

SEQ ID NO: 13218 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgactccttcagctccgggtactggaactggatccgcaagcaccccggcaaggggctcgagtacatcggctacatcagctacaacggcatcacgtaccacaacccctccctcaagagccggatcaccatcaaccgcgacacctccaagaaccagttcagcctgcagctgaactccgtgacccccgaggacacggccgtctactactgcgcgcggtaccgctacgactacgacgggggccacgccatggactactgggggcagggcaccctggtgaccgtgagctcc

SEQ ID NO: 13219 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgggatcacgtaccacaacccctccctcaagagccggatcaccatcaaccccgacacctccaagaaccagtacagcctgcagctgaactccgtgaccccggaggacacggccgtctacttctgcgcgcgctaccggtacgactacgacggcgggcacgccatggactactggggccaggggaccctggtgaccgtgagctcc

SEQ ID NO: 13220 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgggatcacgtaccacaacccctccctcaagagccggatcaccatcaaccgcgacacctccaagaaccagtacagcctgcagctgaactccgtgacccccgaggacacggccgtctacttctgcgcgcggtaccgctacgactacgacggcgggcacgccatggactactggggccaggggaccctggtgaccgtgagctcc

SEQ ID NO: 13221 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgggatcacgtaccacaacccctccctcaagagccggatcaccatcaaccgcgacacctccaagaaccagtacagcctgcagctgaactccgtgacccccgaggacacggccgtctactactgcgcgcggtaccgctacgactacgacggcgggcacgccatggactactggggccaggggaccctggtgaccgtgagctcc

SEQ ID NO: 13222 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgggatcacgtaccacaacccctccctcaagagccggatcaccatcaaccccgacacctccaagaaccagtacagcctgcagctgaactccgtgaccccggaggacacggccgtctactactgcgcgcgctaccggtacgactacgacggcgggcacgccatggactactggggccaggggaccctggtgaccgtgagctcc

SEQ ID NO: 13223 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgccatcacgtaccacaacccctccctcaagagccggatcaccatcaaccgcgacacctccaagaaccagtacagcctgcagctgaactccgtgacccccgaggacacggcggtctactactgcgcccggtacaagtacgactacgacgccgggcacgccatggactactggggccaggggaccctggtgaccgtgagctcc

SEQ ID NO: 13224 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgccatcacgtaccacaacccctccctcaagagccggatcaccatcaaccgcgacacctccaagaaccagtacagcctgcagctgaactccgtgacccccgaggacacggcggtctactactgcgcccggtaccgctacgactacgacgggggccacgccatggactactgggggcagggcaccctggtgaccgtgagctcc

SEQ ID NO: 13225 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgggatcacgtaccacaacccctccctcaagagccggatcaccatcaaccgcgacacctccaagaaccagtacagcctgcagctgaactccgtgacccccgaggacacggccgtctactactgcgcgcggtacaagtacgactacgacggcgggcacgccatggactactggggccaggggaccctggtgaccgtgagctcc

SEQ ID NO: 13226 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctactccgggatcacgtaccacaaccccagcctgaagtcccggatcaccatcaaccgcgacaccagcaagaaccagtactccctgcagctcaacagcgtgacccccgaggacacggccgtctactactgcgcgcggtaccgctacgactacgacggcgggcacgccatggactactggggccaggggaccctggtgaccgtgtccagc

SEQ ID NO: 13227 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctactccgggatcacgtaccacaaccccagcctgaagtcccggatcaccatcaaccgcgacaccagcaagaaccagtactccctgcagctcaacagcgtgacccccgaggacacggccgtctactactgcgcgcggtacaagtacgactacgacggcgggcacgccatggactactggggccaggggaccctggtgaccgtgtccagc

SEQ ID NO: 13228 - RNA, 363 nt, synthetic construct
  misc_feature 1..363: note = derived and/or modified sequence opt1 from anti-OX40_HeavyChain
  source 1..363: mol_type = other RNA
gaggtgcagctgcaggagagcggcccctccctcgtcaagccgagccagaccctgtccctgacctgcagcgtgacgggggactccttcaccagcggctactggaactggatccgcaagttccccgggaaccggctcgagtacatgggctacatctcctacaacgccatcacctaccacaaccccagcctgaagtcccgcatcagcatcacccgggacacgtccaagaaccactactacctgcagctcaacagcgtgaccaccgaggacaccgccacgtacttctgcgcgcgctaccggtacgactacgacgggggccacgccatggactactggggccaggggaccctggtcaccgtgtccagc

SEQ ID NO: 13229 - RNA, 363 nt, synthetic construct
  misc_feature 1..363: note = derived and/or modified sequence opt1 from anti-OX40_HeavyChain
  source 1..363: mol_type = other RNA
caggtgcagctgcaggagagcggccccgggctcgtcaagccgtcccagaccctgagcctgacctgcgccgtgtacggcgggtccttcagctccggctactggaactggatccgcaagcaccccgggaagggcctcgagtacatcggctacatcagctacaacgccatcacgtaccacaacccctccctcaagagccggatcaccatcaaccgcgacacctccaagaaccagtacagcctgcagctgaactccgtgacccccgaggacacggcggtctactactgcgcccggtacaagtacgactacgacgggggccacgccatggactactgggggcagggcaccctggtgaccgtgagctcc

SEQ ID NO: 13230 - RNA, 372 nt, synthetic construct
  misc_feature 1..372: note = derived and/or modified sequence opt1 from anti-OX40_HeavyChain
  source 1..372: mol_type = other RNA
gaggtgcagctggtcgagagcggcgggggcctcgtgcagcccgggcgctccctgcggctgagctgcgccgcctccggcttcaccttcgacgactacgcgatgcactgggtgcgccaggccccggggaagggcctcgagtgggtcagcggcatctcctggaacagcgggtccatcggctacgccgacagcgtgaaggggcggttcaccatctcccgcgacaacgccaagaacagcctgtacctgcagatgaactccctccgggccgaggacacggcgctgtactactgcgccaaggaccagagcaccgccgactactacttctactacggcatggacgtgtgggggcagggcaccaccgtcacggtgtccagc

SEQ ID NO: 13231 - RNA, 381 nt, synthetic construct
  misc_feature 1..381: note = derived and/or modified sequence opt1 from anti-OX40_LightChain
  source 1..381: mol_type = other RNA
atggagacccccgcccagctcctgttcctgctgctcctgtggctgccggacaccacgggcgagatcgtgctcacccagagccccgggaccctgtccctgagccccggcgagcgcgccatcctctcctgccgggcgagccagtccgtcagctccagcttcctggcctggtaccagcagaagcccgggcaggccccgcgcctgctcatctacggcgccttctcccgggccaccgggatccccgaccgcttcagcggctccggcagcgggacggacttcaccctgaccatctcccggctggagcccgaggacttcgcggtgtactactgccagcagtacgacagctcccgcaccttcggccaggggacgaaggtggagatcaag

SEQ ID NO: 13232 - RNA, 381 nt, synthetic construct
  misc_feature 1..381: note = derived and/or modified sequence opt1 from anti-OX40_LightChain
  source 1..381: mol_type = other RNA
atggaggcccccgcccagctcctgttcctgctgctcctgtggctgccggacaccaccggcgagatcgtgctcacgcagagccccgcgaccctgtccctgagccccggggagcgcgccaccctctcctgccgggccagccagggcgtctccagctacctggcctggtaccagcagaagcccgggcaggccccgcgcctgctcatctacgacgcgtccaaccgggccaccggcatccccgcccgcttcagcgggtccggccccggcacggacttcaccctgaccatcagctccctggagcccgaggacttcgccgtgtactactgccagcagcggagcaactggcacccgaccttcgggcagggcacgaaggtggagatcaag

SEQ ID NO: 13233 - RNA, 381 nt, synthetic construct
  misc_feature 1..381: note = derived and/or modified sequence opt1 from anti-OX40_LightChain
  source 1..381: mol_type = other RNA
atggaggcccccgcccagctcctgttcctgctgctcctgtggctgccggacaccaccggcgagatcgtgctcacgcagagccccgcgaccctgtccctgagccccggggagcgcgccaccctctcctgccgggccagccagtccgtcagctcctacctggcctggtaccagcagaagcccggccaggccccgcgcctgctcatctacgacgcgagcaaccgggccaccgggatccccgcccgcttctccggcagcgggtccggcacggacttcaccctgaccatcagctccctggagcccgaggacttcgccgtgtactactgccagcagcggagcaactggcccatcaccttcggccaggggacgcgcctcgagatcaag

SEQ ID NO: 13234 - RNA, 387 nt, synthetic construct
  misc_feature 1..387: note = derived and/or modified sequence opt1 from anti-OX40_LightChain
  source 1..387: mol_type = other RNA
atggagacccccgcccagctcctgttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccagccgggccacggggatccccgaccgcttctccggcagcggctccgggaccgacttcaccctgaccatcagccggctggagcccgaggacttcgcggtgtactactgccagcagtacgactccagcctcacgttcggcgggggcaccaaggtggagatcaagcgcacc

SEQ ID NO: 13235 - RNA, 390 nt, synthetic construct
  misc_feature 1..390: note = derived and/or modified sequence opt1 from anti-OX40_LightChain
  source 1..390: mol_type = other RNA
atggacatgcgcgtgctggcccagctcctgggcctgctcctgctgtgcttccccggggcccggtgcgacatccagatgacccagagcccgtccagcctctccgcgagcgtcggcaaccgcgtgaccatcacgtgccgggcctcccaggacatcagctcctggctggcctggtaccagcagaagcccgagaaggcccccaagagcctgatctacgccgcgtccagcctccagtccggggtgcccagccgcttctccggcagcgggtccggcaccgacttcaccctgaccatcagctccctgcagccggaggacttcgccacgtactactgccagcagtacaacagctaccccctcaccttcggccaggggacccggctggagatcaagcgc

SEQ ID NO: 13236 - RNA, 408 nt, synthetic construct
  misc_feature 1..408: note = derived and/or modified sequence opt1 from anti-OX40_HeavyChain
  source 1..408: mol_type = other RNA
atggacaccctgtgcagcaccctcctgctgctcacgatcccctcctgggtgctgagccagatcaccctgaaggagtccggcccgaccctcgtcaagcccacccagacgctgaccctgagctgcaccttctccgggttcagcctctccaccagcggcgtgggggtgggctggatccgccagccgcccgggaaggccctggagtggctggccctcatccactgggacgacgcggagcggtactcccccagcctgaagtcccgcctgacgatcaccaaggacaccagcaagaaccaggtcgtgctcaccatgacgaacatggacctggtggacaccgccacctactactgcgcccacacccggggcgccttcgacatctggggccaggggacgatggtcaccgtgtccagc

SEQ ID NO: 13237 - RNA, 408 nt, synthetic construct
  misc_feature 1..408: note = derived and/or modified sequence opt1 from anti-OX40_HeavyChain
  source 1..408: mol_type = other RNA
atggacaccctgtgcagcaccctcctgctgctcacgatcccctcctgggtgctgagccagatcaccctgaaggagtccggcccgaccctcgtcaagcccacccagacgctgaccctgacctgcaccttcagcgggttctccctcagcacgtccggcgtgggggtgggctggatccgccagccgcccgggaaggccctggagtggctggccctcatctactgggacgaccacagcccctactcccccagcctgaagtcccggctgaccatcaccaaggacaccagcaagaaccaggtcgtgctcacgatgaccaacatggaccccgtggacaccgcgacctactactgcgcccgcacgcggggcgccttcgacatctggggccaggggaccatggtcaccgtgtccagc

SEQ ID NO: 13238 - RNA, 420 nt, synthetic construct
  misc_feature 1..420: note = derived and/or modified sequence opt1 from anti-OX40_HeavyChain
  source 1..420: mol_type = other RNA
atggagtggggcccctgctgggtgttcctggtcgtgatcctcgagggggtgcagtgcggcgtccagctggtggagagcgggggcgggctggtgcagccgggcggctccctccggctgagctgcgccgcctccgggttcaccttcagctcctacagcatgaactgggtccggcaggcgcccggcaaggggctggagtgggtgtcctacatcagctccagctccagcaccatctactacgccgactccgtgaagggccgcttcacgatcagccgggacaacgccaagaactccctctacctgcagatgaacagcctgcgcgacgaggacaccgccgtctactactgcgcccgcggggtgtaccacaacggctggtccttcttcgactactggggccaggggaccctcctgaccgtgagctcc

SEQ ID NO: 13239 - RNA, 423 nt, synthetic construct
  misc_feature 1..423: note = derived and/or modified sequence opt1 from anti-OX40_HeavyChain
  source 1..423: mol_type = other RNA
atggacaccctgtgcagcaccctcctgctgctcacgatcccctcctgggtgctgagccagatcaccctgaaggagtccggcccgaccctcgtcaagcccaagcagaccctgacgctgacctgcaccttcagcgggttctccctcagcacctccggcatgggggtgggctggatccgccagccgcccgggaaggccctggagtggctggccgtgatctactgggacgaccaccagctctacagcccctccctcaagagccggctgacgatcaccaaggacacctccaagaaccaggtcgtgctgaccatgacgaacatggaccccgtggacaccgcgacctactactgcgcccaccgccggggcgccttccagcactggggccaggggaccctggtcacggtgagctccgccagcaccaagggc

SEQ ID NO: 13240 - RNA, 462 nt, synthetic construct
  misc_feature 1..462: note = derived and/or modified sequence opt1 from anti-OX40_HeavyChain
  source 1..462: mol_type = other RNA
atgaccatgatcacccccagcctggtgccgtccagcgaccccctcgtcacggccgcctccgtgctggagttcgcgctgctcatccgcctgaccatcggccaggccgtggtcagcacccagtccaccgggggcgggctggtgcagcccggccggagcctccgcctgtcctgcgccgccagcgggttcacgctggacgactacggcatgcactgggtgcggcaggcccccggcaaggggctcgagtgggtctccggcatcagctggaactccgacagcatcgggtacgtggactccgtgaagggccgcttcaccatcagccgggacaacgcgaagaactccctgtacctgcagatgaacagcctccgcgtcgaggacaccgccctgtactactgcgtgaaggacatctccgggtggtacagcttcgactactggggccagggcaccctggtgacggtctccagc

SEQ ID NO: 13241 - RNA, 639 nt, synthetic construct
  misc_feature 1..639: note = derived and/or modified sequence opt1 from anti-OX40_LightChain
  source 1..639: mol_type = other RNA
gagatcgtggtcacccagagccccgccaccctgtccctcagcccgggcgagcgcgccacgctgtcctgccgggcgagccagtccgtgagctcctacctggcctggtaccagcagaagcccgggcaggcgccccgcctcctgatctacgacgccagcaaccgggccaccggcatccccgcccgcttctccgggagcggctccgggaccgacttcaccctgacgatcagctccctcgagccggaggacttcgccgtgtactactgccagcagcggagcaactggcccaccttcggccagggcaccaaggtcgagatcaagcgcaccgtggccgccccctccgtgttcatcttcccgcccagcgacgagcagctgaagtccgggacggcgagcgtcgtgtgcctgctcaacaacttctacccccgggaggccaaggtgcagtggaaggtcgacaacgccctgcagtccggcaacagccaggagagcgtgaccgagcaggactccaaggacagcacctactccctgagctccaccctcacgctgagcaaggccgactacgagaagcacaaggtgtacgcctgcgaggtcacccaccaggggctgtccagccccgtgaccaagtccttcaaccgcggcgagtgc

SEQ ID NO: 13242 - RNA, 1350 nt, synthetic construct
  misc_feature 1..1350: note = derived and/or modified sequence opt1 from anti-OX40_HeavyChain
  source 1..1350: mol_type = other RNA
gaggtgcagctggtcgagagcggcgggggcctcgtgcagcccgggcgctccctgcggctgagctgcgccgcctccggcttcaccttcgacgactacgcgatgcactgggtgcgccaggccccggggaagggcctcgagtgggtcagcggcatctcctggaacagcgggtccatcggctacgccgacagcgtgaaggggcggttcaccatctcccgcgacaacgccaagaacagcctgtacctgcagatgaactccctccgggccgaggacacggcgctgtactactgcgccaaggaccagagcaccgccgactactacttctactacggcatggacgtgtgggggcagggcaccaccgtcacggtgtccagcgcctccaccaagggccccagcgtgttccccctggcgccctgctcccgcagcacctccgagagcaccgccgccctcgggtgcctggtcaaggactacttcccggagcccgtgacggtgagctggaactccggcgccctgaccagcggggtccacaccttccccgccgtgctccagtccagcggcctgtactccctgagctccgtggtcaccgtgcccagctccaacttcggcacgcagacctacacgtgcaacgtggaccacaagccgagcaacaccaaggtcgacaagaccgtggagcggaagtgctgcgtggagtgcccgccctgccccgcgccgcccgtcgccgggccctccgtgttcctcttcccgcccaagcccaaggacaccctgatgatcagccgcacccccgaggtgacctgcgtcgtggtcgacgtgtcccacgaggaccccgaggtgcagttcaactggtacgtcgacggcgtggaggtgcacaacgccaagacgaagccccgggaggagcagttcaacagcaccttccgcgtcgtgtccgtgctgaccgtcgtgcaccaggactggctcaacgggaaggagtacaagtgcaaggtgagcaacaagggcctgcccgcccccatcgagaagaccatctccaagacgaaggggcagccccgggagccgcaggtctacaccctgccgcccagccgcgaggagatgaccaagaaccaggtgtccctgacctgcctcgtgaagggcttctaccccagcgacatcgccgtcgagtgggagagcaacggccagcccgagaacaactacaagacgaccccgcccatgctggactccgacgggagcttcttcctctactccaagctgaccgtggacaagagccggtggcagcagggcaacgtgttctcctgcagcgtcatgcacgaggcgctgcacaaccactacacccagaagtccctcagcctgtcccccgggaag

SEQ ID NO: 13243 - RNA, 21 nt, synthetic construct
  misc_feature 1..21: note = derived and/or modified sequence opt1 from anti-HIV_VRC01_VRC02_NIH45-46_LightChain_CDR
  source 1..21: mol_type = other RNA
tgccagcagtacgagttcttc

SEQ ID NO: 13244 - RNA, 42 nt, synthetic construct
  misc_feature 1..42: note = derived and/or modified sequence opt1 from anti-HIV_VRC01_HeavyChain_CDR
  source 1..42: mol_type = other RNA
acccgcggcaagaactgcgactacaactgggacttcgagcac

SEQ ID NO: 13245 - RNA, 21 nt, synthetic construct
  misc_feature 1..21: note = derived and/or modified sequence opt1 from anti-HIV_3BNC60_LightChain_CDR
  source 1..21: mol_type = other RNA
tgccaggtgtacgagttcatc

SEQ ID NO: 13246 - RNA, 36 nt, synthetic construct
  misc_feature 1..36: note = derived and/or modified sequence opt1 from anti-HIV_3BNC60_HeavyChain_CDR
  source 1..36: mol_type = other RNA
gcccgccagcggagcgacttctgggacttcgacgtg

SEQ ID NO: 13247 - RNA, 36 nt, synthetic construct
  misc_feature 1..36: note = derived and/or modified sequence opt1 from anti-HIV_5H/I1-BMV-D5_HeavyChain_CDR
  source 1..36: mol_type = other RNA
gcccgcgacaaccccaccctgctcggcagcgactac

SEQ ID NO: 13248 - RNA, 33 nt, synthetic construct
  misc_feature 1..33: note = derived and/or modified sequence opt1 from anti-HIV_8ANC195_LightChain_CDR
  source 1..33: mol_type = other RNA
tgccagcagtacgacacctaccccggcaccttc

SEQ ID NO: 13249 - RNA, 33 nt, synthetic construct
  misc_feature 1..33: note = derived and/or modified sequence opt1 from anti-HIV_CH01_CH02_CH03_LightChain_CDR
  source 1..33: mol_type = other RNA
tgccagcagtacggcgggagcccctacaccttc

SEQ ID NO: 13250 - RNA, 78 nt, synthetic construct
  misc_feature 1..78: note = derived and/or modified sequence opt1 from anti-HIV_CH01_HeavyChain_CDR
  source 1..78: mol_type = other RNA
gcccgcggcaccgactacaccatcgacgacgccgggatccactaccagggcagcgggacgttctggtacttcgacctg

SEQ ID NO: 13251 - RNA, 78 nt, synthetic construct
  misc_feature 1..78: note = derived and/or modified sequence opt1 from anti-HIV_CH02_HeavyChain_CDR
  source 1..78: mol_type = other RNA
gcccgcggcaccgactacaccatcgacgaccaggggcggttctaccagggcagcgggacgttctggtacttcgacttc

SEQ ID NO: 13252 - RNA, 78 nt, synthetic construct
  misc_feature 1..78: note = derived and/or modified sequence opt1 from anti-HIV_CH03_HeavyChain_CDR
  source 1..78: mol_type = other RNA
gcccgcggcaccgactacaccatcgacgaccaggggatcttctacaagggcagcgggacgttctggtacttcgacctg

SEQ ID NO: 13253 - RNA, 33 nt, synthetic construct
  misc_feature 1..33: note = derived and/or modified sequence opt1 from anti-HIV_CH04_LightChain_CDR
  source 1..33: mol_type = other RNA
tgccagcagtacggccgcagcccctacaccttc

SEQ ID NO: 13254 - RNA, 78 nt, synthetic construct
  misc_feature 1..78: note = derived and/or modified sequence opt1 from anti-HIV_CH04_HeavyChain_CDR
  source 1..78: mol_type = other RNA
gcccgcggcaccgactacaccatcgacgaccaggggatccggtaccagggcagcgggacgttctggtacttcgacgtg

SEQ ID NO: 13255 - RNA, 54 nt, synthetic construct
  misc_feature 1..54: note = derived and/or modified sequence opt1 from anti-HIV_NIH45-46_HeavyChain_CDR
  source 1..54: mol_type = other RNA
acccgcggcaagtactgcaccgcccgggactactacaactgggacttcgagcac

SEQ ID NO: 13256 - RNA, 90 nt, synthetic construct
  misc_feature 1..90: note = derived and/or modified sequence opt1 from anti-HIV_PG16_HeavyChain_CDR
  source 1..90: mol_type = other RNA
gcccgcgaggccggcgggcccatctggcacgacgacgtgaagtactacgacttcaacgacggctactacaactaccactacatggacgtc

SEQ ID NO: 13257 - RNA, 36 nt, synthetic construct
  misc_feature 1..36: note = derived and/or modified sequence opt1 from anti-HIV_PGT122_LightChain_CDR
  source 1..36: mol_type = other RNA
cacatctgggacagccgccggcccaccaactgggtg

SEQ ID NO: 13258 - RNA, 72 nt, synthetic construct
  misc_feature 1..72: note = derived and/or modified sequence opt1 from anti-HIV_PGT122_HeavyChain_CDR
  source 1..72: mol_type = other RNA
accaagcacggccgccggatctacggggtggtcgccttcaaggagtggttcacctacttctacatggacgtg

SEQ ID NO: 13259 - RNA, 36 nt, synthetic construct
  misc_feature 1..36: note = derived and/or modified sequence opt1 from anti-HIV_PGT123_LightChain_CDR
  source 1..36: mol_type = other RNA
cacatctacgacgcccgcggcgggaccaactgggtg

SEQ ID NO: 13260 - RNA, 72 nt, synthetic construct
  misc_feature 1..72: note = derived and/or modified sequence opt1 from anti-HIV_PGT123_HeavyChain_CDR
  source 1..72: mol_type = other RNA
gccctgcacggcaagcgcatctacgggatcgtggccctcggcgagctgttcacctacttctacatggacgtc

SEQ ID NO: 13261 - RNA, 30 nt, synthetic construct
  misc_feature 1..30: note = derived and/or modified sequence opt1 from anti-HIV_PGT125_PGT128_LightChain_CDR
  source 1..30: mol_type = other RNA
ggcagcctggtggggaactgggacgtcatc

SEQ ID NO: 13262 - RNA, 57 nt, synthetic construct
  misc_feature 1..57: note = derived and/or modified sequence opt1 from anti-HIV_PGT125_HeavyChain_CDR
  source 1..57: mol_type = other RNA
ttcgacggcgaggtgctggtctacaaccactggcccaagccggcctgggtggacctc

SEQ ID NO: 13263 - RNA, 30 nt, synthetic construct
  misc_feature 1..30: note = derived and/or modified sequence opt1 from anti-HIV_PGT126_PGT127_LightChain_CDR
  source 1..30: mol_type = other RNA
agctccctggtgggcaactgggacgtcatc

SEQ ID NO: 13264 - RNA, 57 nt, synthetic construct
  misc_feature 1..57: note = derived and/or modified sequence opt1 from anti-HIV_PGT126_HeavyChain_CDR
  source 1..57: mol_type = other RNA
ttcgacggcgaggtgctggtctaccacgactggcccaagccggcctgggtggacctc

SEQ ID NO: 13265 - RNA, 57 nt, synthetic construct
  misc_feature 1..57: note = derived and/or modified sequence opt1 from anti-HIV_PGT127_HeavyChain_CDR
  source 1..57: mol_type = other RNA
ttcggcggggaggtgctggtctaccgcgactggcccaagccggcctgggtggacctc

SEQ ID NO: 13266 - RNA, 57 nt, synthetic construct
  misc_feature 1..57: note = derived and/or modified sequence opt1 from anti-HIV_PGT128_HeavyChain_CDR
  source 1..57: mol_type = other RNA
ttcggcggggaggtgctgcgctacaccgactggcccaagccggcctgggtcgacctc

SEQ ID NO: 13267 - RNA, 30 nt, synthetic construct
  misc_feature 1..30: note = derived and/or modified sequence opt1 from anti-HIV_PGT130_LightChain_CDR
  source 1..30: mol_type = other RNA
agctccctgttcggccgctgggacgtggtc

SEQ ID NO: 13268 - RNA, 57 nt, synthetic construct
  misc_feature 1..57: note = derived and/or modified sequence opt1 from anti-HIV_PGT130_HeavyChain_CDR
  source 1..57: mol_type = other RNA
agcggcggggacatcctgtactactacgagtggcagaagccccactggttctccccg

SEQ ID NO: 13269 - RNA, 30 nt, synthetic construct
  misc_feature 1..30: note = derived and/or modified sequence opt1 from anti-HIV_PGT131_LightChain_CDR
  source 1..30: mol_type = other RNA
agctccctgagcggccgctgggacatcgtg

SEQ ID NO: 13270 - RNA, 57 nt, synthetic construct
  misc_feature 1..57: note = derived and/or modified sequence opt1 from anti-HIV_PGT131_HeavyChain_CDR
  source 1..57: mol_type = other RNA
agcggcggggacatcctgtactacatcgagtggcagaagccccactggttctacccg

SEQ ID NO: 13271 - RNA, 27 nt, synthetic construct
  misc_feature 1..27: note = derived and/or modified sequence opt1 from anti-HIV_PGT135_PGT136_PGT137_LightChain_CDR
  source 1..27: mol_type = other RNA
cagcagtacgaggagtggccccgcacc

SEQ ID NO: 13272 - RNA, 54 nt, synthetic construct
  misc_feature 1..54: note = derived and/or modified sequence opt1 from anti-HIV_PGT135_HeavyChain_CDR
  source 1..54: mol_type = other RNA
caccgccaccacgacgtgttcatgctggtccccatcgccggctggttcgacgtg

SEQ ID NO: 13273 - RNA, 54 nt, synthetic construct
  misc_feature 1..54: note = derived and/or modified sequence opt1 from anti-HIV_PGT136_HeavyChain_CDR
  source 1..54: mol_type = other RNA
cacaagtaccacgacatcttccgcgtggtccccgtggccggctggttcgacccg

SEQ ID NO: 13274 - RNA, 54 nt, synthetic construct
  misc_feature 1..54: note = derived and/or modified sequence opt1 from anti-HIV_PGT137_HeavyChain_CDR
  source 1..54: mol_type = other RNA
cacaagtaccacgacatcgtgatggtcgtgcccatcgccggctggttcgacccg

SEQ ID NO: 13275 - RNA, 27 nt, synthetic construct
  misc_feature 1..27: note = derived and/or modified sequence opt1 from anti-HIV_PGT141_PGT142_PGT143_PGT144_LightChain_CDR
  source 1..27: mol_type = other RNA
atgcagggcctgaaccgcccctggacc

SEQ ID NO: 13276 - RNA, 96 nt, synthetic construct
  misc_feature 1..96: note = derived and/or modified sequence opt1 from anti-HIV_PGT141_HeavyChain_CDR
  source 1..96: mol_type = other RNA
ggcagcaagcaccgcctgcgggactacgtgctctacgacgactacgggctgatcaactaccaggagtggaacgactacctggagttcctcgacgtc

SEQ ID NO: 13277 - RNA, 96 nt, synthetic construct
  misc_feature 1..96: note = derived and/or modified sequence opt1 from anti-HIV_PGT144_HeavyChain_CDR
  source 1..96: mol_type = other RNA
ggcagcaagcaccgcctgcgggactacgtgctctacgacgactacgggctgatcaaccagcaggagtggaacgactacctggagttcctcgacgtc

SEQ ID NO: 13278 - RNA, 27 nt, synthetic construct
  misc_feature 1..27: note = derived and/or modified sequence opt1 from anti-HIV_PGT145_LightChain_CDR
  source 1..27: mol_type = other RNA
atgcagggcctgcacagcccctggacc

SEQ ID NO: 13279 - RNA, 93 nt, synthetic construct
  misc_feature 1..93: note = derived and/or modified sequence opt1 from anti-HIV_PGT145_HeavyChain_CDR
  source 1..93: mol_type = other RNA
ggcagcaagcaccgcctgcgggactacttcctctacaacgagtacgggcccaactacgaggagtggggcgactacctggccaccctggacgtg

SEQ ID NO: 13280 - RNA, 21 nt, synthetic construct
  misc_feature 1..21: note = derived and/or modified sequence opt1 from anti-HIV_VRC-CH30_VRC-CH31_VRC-CH32_VRC-CH33_VRC-CH34_Light Chain _CDR
  source 1..21: mol_type = other RNA
tgccagcagtacgagaccttc

SEQ ID NO: 13281 - RNA, 45 nt, synthetic construct
  misc_feature 1..45: note = derived and/or modified sequence opt1 from anti-HIV_VRC-CH30_VRC-CH31_VRC-CH32_VRC-CH34_HeavyChain_CDR
  source 1..45: mol_type = other RNA
gcccgcgcccagaagcggggccgcagcgagtgggcgtacgcccac

SEQ ID NO: 13282 - RNA, 45 nt, synthetic construct
  misc_feature 1..45: note = derived and/or modified sequence opt1 from anti-HIV_VRC-CH33_HeavyChain_CDR
  source 1..45: mol_type = other RNA
gcccgcgcccagaagcgggcgcgcagcgagtgggcctacgcccac

SEQ ID NO: 13283 - RNA, 21 nt, synthetic construct
  misc_feature 1..21: note = derived and/or modified sequence opt1 from anti-HIV_VRC-PG04_LightChain_CDR
  source 1..21: mol_type = other RNA
tgccagcagctggagttcttc

SEQ ID NO: 13284 - RNA, 48 nt, synthetic construct
  misc_feature 1..48: note = derived and/or modified sequence opt1 from anti-HIV_VRC-PG04_HeavyChain_CDR
  source 1..48: mol_type = other RNA
gcccgccagaagttctacaccggcgggcagggctggtacttcgacctg

SEQ ID NO: 13285 - RNA, 21 nt, synthetic construct
  misc_feature 1..21: note = derived and/or modified sequence opt1 from anti-HIV_VRC-PG04b_LightChain_CDR
  source 1..21: mol_type = other RNA
tgccagcaggtggagttcttc

SEQ ID NO: 13286 - RNA, 48 nt, synthetic construct
  misc_feature 1..48: note = derived and/or modified sequence opt1 from anti-HIV_VRC-PG04b_HeavyChain_CDR
  source 1..48: mol_type = other RNA
gcccgccagaagttcgagcggggcgggcagggctggtacttcgacctg

SEQ ID NO: 13287 - RNA, 21 nt, synthetic construct
  misc_feature 1..21: note = derived and/or modified sequence opt1 from anti-HIV_VRC03_LightChain_CDR
  source 1..21: mol_type = other RNA
tgccagcagttcgagttcttc

SEQ ID NO: 13288 - RNA, 48 nt, synthetic construct
  misc_feature 1..48: note = derived and/or modified sequence opt1 from anti-HIV_VRC03_HeavyChain_CDR
  source 1..48: mol_type = other RNA
gtgcgccggggcagctgcgactactgcggggacttcccctggcagtac

SEQ ID NO: 13289 - RNA, 21 nt, synthetic construct
  misc_feature 1..21: note = derived and/or modified sequence opt1 from anti-HIV_1TJG_P-Chain
  source 1..21: mol_type = other RNA
gagctggacaagtgggccagc

SEQ ID NO: 13290 - RNA, 69 nt, synthetic construct
  misc_feature 1..69: note = derived and/or modified sequence opt1 from anti-HIV_2B1H_P-Chain
  source 1..69: mol_type = other RNA
aacaacaccaagaagagcatcaagatccgcccccggcaggccttctacgccaccaacggcatcatcggg

SEQ ID NO: 13291 - RNA, 69 nt, synthetic construct
  misc_feature 1..69: note = derived and/or modified sequence opt1 from anti-HIV_2B1A_P-Chain
  source 1..69: mol_type = other RNA
aacaacacccgcaagagcatccacctgggccccgggcgggccttctacgccaccggcgacatcatcggg

SEQ ID NO: 13292 - RNA, 57 nt, synthetic construct
  misc_feature 1..57: note = derived and/or modified sequence opt1 from anti-HIV_2B0S_P-Chain
  source 1..57: mol_type = other RNA
aagcgcaagcggatccacatcggccccgggcgcgccttctacaccaccaagaacgcc

SEQ ID NO: 13293 - RNA, 69 nt, synthetic construct
  misc_feature 1..69: note = derived and/or modified sequence opt1 from anti-HIV_3UJJ_P-Chain
  source 1..69: mol_type = other RNA
aacaacacccgcaagagcatccggatcggccccgggcaggccttctacgccaccggcgacatcatcggg

SEQ ID NO: 13294 - RNA, 69 nt, synthetic construct
  misc_feature 1..69: note = derived and/or modified sequence opt1 from anti-HIV_3UJI_P-Chain
  source 1..69: mol_type = other RNA
tacaacaagcgcaagcggatccacatcggccccgggcgcgccttctacaccaccaagaacatcatcggc

SEQ ID NO: 13295 - RNA, 75 nt, synthetic construct
  misc_feature 1..75: note = derived and/or modified sequence opt1 from anti-HIV_3MLZ_P-Chain
  source 1..75: mol_type = other RNA
agcaacaacacccgcaagggcatccacatcgggcccggccgggccttctacgccaccgggcagatcacgggcgac

SEQ ID NO: 13296 - RNA, 60 nt, synthetic construct
  misc_feature 1..60: note = derived and/or modified sequence opt1 from anti-HIV_3MLV_Q-Chain
  source 1..60: mol_type = other RNA
aacaacacccgcaagcggatccgcgtgggccccgggcagaccgtctacgccacgaacgcc

SEQ ID NO: 13297 - RNA, 69 nt, synthetic construct
  misc_feature 1..69: note = derived and/or modified sequence opt1 from anti-HIV_3MLU_P-Chain
  source 1..69: mol_type = other RNA
aacaacacccgcaagagcatccggatcggccccgggcaggccttctacgccaccggcgggatcatcggc

SEQ ID NO: 13298 - RNA, 60 nt, synthetic construct
  misc_feature 1..60: note = derived and/or modified sequence opt1 from anti-HIV_3MLR_P-Chain
  source 1..60: mol_type = other RNA
aacaacaccaagaagggcatcgccatcgggcccggccgcaccctgtacgcccgggagaag

SEQ ID NO: 13299 - RNA, 48 nt, synthetic construct
  misc_feature 1..48: note = derived and/or modified sequence opt1 from anti-HIV_4XCF_P-Chain
  source 1..48: mol_type = other RNA
aactggtgggacatcaccaactggctgtggtacatcaagaagaagaag

SEQ ID NO: 13300 - RNA, 45 nt, synthetic construct
  misc_feature 1..45: note = derived and/or modified sequence opt1 from anti-HIV_4XBE_P-Chain
  source 1..45: mol_type = other RNA
aactggttcgacatcaccaactggctgtggtacatcaagaagaag

SEQ ID NO: 13301 - RNA, 48 nt, synthetic construct
  misc_feature 1..48: note = derived and/or modified sequence opt1 from anti-HIV_4XAW_P-Chain
  source 1..48: mol_type = other RNA
aactggttcgacatcaccaactggctgtggtacatcaagaagaagaag

SEQ ID NO: 13302 - RNA, 45 nt, synthetic construct
  misc_feature 1..45: note = derived and/or modified sequence opt1 from anti-HIV_2QSC_P-Chain
  source 1..45: mol_type = other RNA
cgcaagcggatccacatcggccccgggcgcgccttctacaccacc

SEQ ID NO: 13303 - RNA, 60 nt, synthetic construct
  misc_feature 1..60: note = derived and/or modified sequence opt1 from anti-HIV_3MLS_S-Chain
  source 1..60: mol_type = other RNA
gcctgccaggccttctacgcgagcagcccccgcaagtccatccacatcggcgcctgcgcc

SEQ ID NO: 13304 - RNA, 42 nt, synthetic construct
  misc_feature 1..42: note = derived and/or modified sequence opt1 from anti-HIV_3GO1_P-Chain
  source 1..42: mol_type = other RNA
cgcaagcggatccacatcggccccgggcgcgccttctacacc

SEQ ID NO: 13305 - RNA, 42 nt, synthetic construct
  misc_feature 1..42: note = derived and/or modified sequence opt1 from anti-HIV_4M1D_Q-Chain
  source 1..42: mol_type = other RNA
tgccgcatccacatcggccccgggcgggccttctacacctgc

SEQ ID NO: 13306 - RNA, 39 nt, synthetic construct
  misc_feature 1..39: note = derived and/or modified sequence opt1 from anti-HIV_3C2A_Q-Chain
  source 1..39: mol_type = other RNA
aagagcatccacctgggccccgggcgcgccttctacgcc

SEQ ID NO: 13307 - RNA, 12 nt, synthetic construct
  misc_feature 1..12: note = derived and/or modified sequence opt1 from anti-HIV_CDR
  source 1..12: mol_type = other RNA
cagagcaagacc

SEQ ID NO: 13308 - RNA, 12 nt, synthetic construct
  misc_feature 1..12: note = derived and/or modified sequence opt1 from anti-HIV_CDR
  source 1..12: mol_type = other RNA
gacctgatcgac

SEQ ID NO: 13309 - RNA, 15 nt, synthetic construct
  misc_feature 1..15: note = derived and/or modified sequence opt1 from anti-HIV_CDR
  source 1..15: mol_type = other RNA
gaccactactggagc

SEQ ID NO: 13310 - RNA, 15 nt, synthetic construct
  misc_feature 1..15: note = derived and/or modified sequence opt1 from anti-HIV_CDR
  source 1..15: mol_type = other RNA
ggccgcttctggagc

SEQ ID NO: 13311 - RNA, 15 nt, synthetic construct
  misc_feature 1..15: note = derived and/or modified sequence opt1 from anti-HIV_CDR
  source 1..15: mol_type = other RNA
aactactactggacc

SEQ ID NO: 13312 - RNA, 15 nt, synthetic construct
  misc_feature 1..15: note = derived and/or modified sequence opt1 from anti-HIV_CDR
  source 1..15: mol_type = other RNA
gacgcctactggagc

SEQ ID NO: 13313 - RNA, 15 nt, synthetic construct
  misc_feature 1..15: note = derived and/or modified sequence opt1 from anti-HIV_CDR
  source 1..15: mol_type = other RNA
gacagctactggtcc

SEQ ID NO: 13314 - RNA, 15 nt, synthetic construct
  misc_feature 1..15: note = derived and/or modified sequence opt1 from anti-HIV_CDR
  source 1..15: mol_type = other RNA
gacaactactggagc

SEQ ID NO: 13315 - RNA, 15 nt, synthetic construct
  misc_feature 1..15: note = derived and/or modified sequence opt1 from anti-HIV_CDR
  source 1..15: mol_type = other RNA
aacagctactggacc

SEQ ID NO: 13316 - RNA, 15 nt, synthetic construct
  misc_feature 1..15: note = derived and/or modified sequence opt1 from anti-HIV_CDR
  source 1..15: mol_type = other RNA
agctactactggtcc

SEQ ID NO: 13317 - RNA, 15 nt, synthetic construct
  misc_feature 1..15: note = derived and/or modified sequence opt1 from anti-HIV_CDR
  source 1..15: mol_type = other RNA
agcttcggcatgcac

SEQ ID NO: 13318 - RNA, 15 nt, synthetic construct
  misc_feature 1..15: note = derived and/or modified sequence opt1 from anti-HIV_CDR
  source 1..15: mol_type = other RNA
gccgccttccagtgg

SEQ ID NO: 13319 - RNA, 15 nt, synthetic construct
  misc_feature 1..15: note = derived and/or modified sequence opt1 from anti-HIV_CDR
  source 1..15: mol_type = other RNA
cagcagctgcgcacc

SEQ ID NO: 13320 - RNA, 15 nt, synthetic construct
  misc_feature 1..15: note = derived and/or modified sequence opt1 from anti-HIV_CDR
  source 1..15: mol_type = other RNA
cagcagtacgacagc

SEQ ID NO: 13321 - RNA, 15 nt, synthetic construct
  misc_feature 1..15: note = derived and/or modified sequence opt1 from anti-HIV_CDR
  source 1..15: mol_type = other RNA
cagcagctggccacc

SEQ ID NO: 13322 - RNA, 15 nt, synthetic construct
  misc_feature 1..15: note = derived and/or modified sequence opt1 from anti-HIV_CDR
  source 1..15: mol_type = other RNA
gagagcttccagtgg

SEQ ID NO: 13323 - RNA, 15 nt, synthetic construct
  misc_feature 1..15: note = derived and/or modified sequence opt1 from anti-HIV_CDR
  source 1..15: mol_type = other RNA
gaggtgtacgagttc

SEQ ID NO: 13324 - RNA, 15 nt, synthetic construct
  misc_feature 1..15: note = derived and/or modified sequence opt1 from anti-HIV_CDR
  source 1..15: mol_type = other RNA
gccagcctggagttc

SEQ ID NO: 13325 - RNA, 15 nt, synthetic construct
  misc_feature 1..15: note = derived and/or modified sequence opt1 from anti-HIV_CDR
  source 1..15: mol_type = other RNA
agcgtgtacgagttc

SEQ ID NO: 13326 - RNA, 15 nt, synthetic construct
  misc_feature 1..15: note = derived and/or modified sequence opt1 from anti-HIV_CDR
  source 1..15: mol_type = other RNA
gccgccctggagttc

SEQ ID NO: 13327 - RNA, 15 nt, synthetic construct
  misc_feature 1..15: note = derived and/or modified sequence opt1 from anti-HIV_CDR
  source 1..15: mol_type = other RNA
gccgtggtcgagttc

SEQ ID NO: 13328 - RNA, 15 nt, synthetic construct
  misc_feature 1..15: note = derived and/or modified sequence opt1 from anti-HIV_CDR
  source 1..15: mol_type = other RNA
cagctgttcgagttc

SEQ ID NO: 13329 - RNA, 15 nt, synthetic construct
  misc_feature 1..15: note = derived and/or modified sequence opt1 from anti-HIV_CDR
  source 1..15: mol_type = other RNA
gccgtgttccagtgg

SEQ ID NO: 13330 - RNA, 15 nt, synthetic construct
  misc_feature 1..15: note = derived and/or modified sequence opt1 from anti-HIV_CDR
  source 1..15: mol_type = other RNA
gccgtgctggagttc

SEQ ID NO: 13331 - RNA, 15 nt, synthetic construct
  misc_feature 1..15: note = derived and/or modified sequence opt1 from anti-HIV_CDR
  source 1..15: mol_type = other RNA
aacggcttcgacgtg

SEQ ID NO: 13332 - RNA, 15 nt, synthetic construct
  misc_feature 1..15: note = derived and/or modified sequence opt1 from anti-HIV_CDR
  source 1..15: mol_type = other RNA
cagcagtacgagttc

SEQ ID NO: 13333 - RNA, 15 nt, synthetic construct
  misc_feature 1..15: note = derived and/or modified sequence opt1 from anti-HIV_CDR
  source 1..15: mol_type = other RNA
cagcactacgagttc

SEQ ID NO: 13334 - RNA, 15 nt, synthetic construct
  misc_feature 1..15: note = derived and/or modified sequence opt1 from anti-HIV_CDR
  source 1..15: mol_type = other RNA
caggtgtacgaggtc

SEQ ID NO: 13335 - RNA, 15 nt, synthetic construct
  misc_feature 1..15: note = derived and/or modified sequence opt1 from anti-HIV_CDR
  source 1..15: mol_type = other RNA
caggtgtacgagttc

SEQ ID NO: 13336 - RNA, 15 nt, synthetic construct
  misc_feature 1..15: note = derived and/or modified sequence opt1 from anti-HIV_CDR
  source 1..15: mol_type = other RNA
ttcagcaaggagtcc

SEQ ID NO: 13337 - RNA, 15 nt, synthetic construct
  misc_feature 1..15: note = derived and/or modified sequence opt1 from anti-HIV_CDR
  source 1..15: mol_type = other RNA
ctgaagctcagctcc

SEQ ID NO: 13338 - RNA, 15 nt, synthetic construct
  misc_feature 1..15: note = derived and/or modified sequence opt1 from anti-HIV_CDR
  source 1..15: mol_type = other RNA
tacaaggtgagctcc

SEQ ID NO: 13339 - RNA, 15 nt, synthetic construct
  misc_feature 1..15: note = derived and/or modified sequence opt1 from anti-HIV_CDR
  source 1..15: mol_type = other RNA
cccccgcaggagagc

SEQ ID NO: 13340 - RNA, 15 nt, synthetic construct
  misc_feature 1..15: note = derived and/or modified sequence opt1 from anti-HIV_CDR
  source 1..15: mol_type = other RNA
accgcccgcgactac

SEQ ID NO: 13341 - RNA, 15 nt, synthetic construct
  misc_feature 1..15: note = derived and/or modified sequence opt1 from anti-HIV_CDR
  source 1..15: mol_type = other RNA
atgcagagcatccag

SEQ ID NO: 13342 - RNA, 15 nt, synthetic construct
  misc_feature 1..15: note = derived and/or modified sequence opt1 from anti-HIV_CDR
  source 1..15: mol_type = other RNA
caccagctggacacc

SEQ ID NO: 13343 - RNA, 15 nt, synthetic construct
  misc_feature 1..15: note = derived and/or modified sequence opt1 from anti-HIV_CDR
  source 1..15: mol_type = other RNA
caccagctggacagc

SEQ ID NO: 13344 - RNA, 15 nt, synthetic construct
  misc_feature 1..15: note = derived and/or modified sequence opt1 from anti-HIV_CDR
  source 1..15: mol_type = other RNA
cagcagctgggcacc

SEQ ID NO: 13345 - RNA, 15 nt, synthetic construct
  misc_feature 1..15: note = derived and/or modified sequence opt1 from anti-HIV_CDR
  source 1..15: mol_type = other RNA
cagaaggccaccacc

SEQ ID NO: 13346 - RNA, 15 nt, synthetic construct
  misc_feature 1..15: note = derived and/or modified sequence opt1 from anti-HIV_CDR
  source 1..15: mol_type = other RNA
ctgttcgccggcacc

SEQ ID NO: 13347 - RNA, 18 nt, synthetic construct
  misc_feature 1..18: note = derived and/or modified sequence opt1 from anti-HIV_CDR
  source 1..18: mol_type = other RNA
gtgcgcggcagctccccc

SEQ ID NO: 13348 - RNA, 18 nt, synthetic construct
  misc_feature 1..18: note = derived and/or modified sequence opt1 from anti-HIV_CDR
  source 1..18: mol_type = other RNA
ggcctcctgttcgtggtc

SEQ ID NO: 13349 - RNA, 18 nt, synthetic construct
  misc_feature 1..18: note = derived and/or modified sequence opt1 from anti-HIV_CDR
  source 1..18: mol_type = other RNA
atggactggacctggagc

SEQ ID NO: 13350 - RNA, 18 nt, synthetic construct
  misc_feature 1..18: note = derived and/or modified sequence opt1 from anti-HIV_CDR
  source 1..18: mol_type = other RNA
atggactggacctggcgc

SEQ ID NO: 13351 - RNA, 18 nt, synthetic construct
  misc_feature 1..18: note = derived and/or modified sequence opt1 from anti-HIV_CDR
  source 1..18: mol_type = other RNA
atgaagcacctgtggttc

SEQ ID NO: 13352 - RNA, 18 nt, synthetic construct
  misc_feature 1..18: note = derived and/or modified sequence opt1 from anti-HIV_CDR
  source 1..18: mol_type = other RNA
atggactggatctggcgc

SEQ ID NO: 13353 - RNA, 18 nt, synthetic construct
  misc_feature 1..18: note = derived and/or modified sequence opt1 from anti-HIV_CDR
  source 1..18: mol_type = other RNA
atggactggacctggacc

SEQ ID NO: 13354 - RNA, 18 nt, synthetic construct
  misc_feature 1..18: note = derived and/or modified sequence opt1 from anti-HIV_CDR
  source 1..18: mol_type = other RNA
atgaagcacctgttcctc

SEQ ID NO: 13355 - RNA, 18 nt, synthetic construct
  misc_feature 1..18: note = derived and/or modified sequence opt1 from anti-HIV_CDR
  source 1..18: mol_type = other RNA
cagctgctccagagcaac

SEQ ID NO: 13356 - RNA, 18 nt, synthetic construct
  misc_feature 1..18: note = derived and/or modified sequence opt1 from anti-HIV_CDR
  source 1..18: mol_type = other RNA
ggcgggagccccgagcac

SEQ ID NO: 13357 - RNA, 18 nt, synthetic construct
  misc_feature 1..18: note = derived and/or modified sequence opt1 from anti-HIV_CDR
  source 1..18: mol_type = other RNA
ctggagggcaccgactac

SEQ ID NO: 13358 - RNA, 18 nt, synthetic construct
  misc_feature 1..18: note = derived and/or modified sequence opt1 from anti-HIV_CDR
  source 1..18: mol_type = other RNA
cagcagtaccccagcacc

SEQ ID NO: 13359 - RNA, 21 nt, synthetic construct
  misc_feature 1..21: note = derived and/or modified sequence opt1 from anti-HIV_CDR
  source 1..21: mol_type = other RNA
aacaaccacgaccgccccagc

SEQ ID NO: 13360 - RNA, 21 nt, synthetic construct
  misc_feature 1..21: note = derived and/or modified sequence opt1 from anti-HIV_CDR
  source 1..21: mol_type = other RNA
aacaaccaggaccgccccgcc

SEQ ID NO: 13361 - RNA, 21 nt, synthetic construct
  misc_feature 1..21: note = derived and/or modified sequence opt1 from anti-HIV_CDR
  source 1..21: mol_type = other RNA
aacaacaacgaccgccccagc

SEQ ID NO: 13362 - RNA, 21 nt, synthetic construct
  misc_feature 1..21: note = derived and/or modified sequence opt1 from anti-HIV_CDR
  source 1..21: mol_type = other RNA
aacaaccaggaccgccccagc

SEQ ID NO: 13363 - RNA, 21 nt, synthetic construct
  misc_feature 1..21: note = derived and/or modified sequence opt1 from anti-HIV_CDR
  source 1..21: mol_type = other RNA
gacgacagcgaccgcccctcc

SEQ ID NO: 13364 - RNA, 21 nt, synthetic construct
  misc_feature 1..21: note = derived and/or modified sequence opt1 from anti-HIV_CDR
  source 1..21: mol_type = other RNA
tgggccagcacccgccacacc

SEQ ID NO: 13365 - RNA, 21 nt, synthetic construct
  misc_feature 1..21: note = derived and/or modified sequence opt1 from anti-HIV_CDR
  source 1..21: mol_type = other RNA
ggcgccaccgcccgcgacttc

SEQ ID NO: 13366 - RNA, 21 nt, synthetic construct
  misc_feature 1..21: note = derived and/or modified sequence opt1 from anti-HIV_CDR
  source 1..21: mol_type = other RNA
gccagcatcaagctggccctc

SEQ ID NO: 13367 - RNA, 21 nt, synthetic construct
  misc_feature 1..21: note = derived and/or modified sequence opt1 from anti-HIV_CDR
  source 1..21: mol_type = other RNA
cagcagtacggccgcagcccc

SEQ ID NO: 13368 - RNA, 21 nt, synthetic construct
  misc_feature 1..21: note = derived and/or modified sequence opt1 from anti-HIV_CDR
  source 1..21: mol_type = other RNA
cagcagtactacatcagcccc

SEQ ID NO: 13369 - RNA, 21 nt, synthetic construct
  misc_feature 1..21: note = derived and/or modified sequence opt1 from anti-HIV_CDR
  source 1..21: mol_type = other RNA
cagcagagccactcccccagc

SEQ ID NO: 13370 - RNA, 21 nt, synthetic construct
  misc_feature 1..21: note = derived and/or modified sequence opt1 from anti-HIV_CDR
  source 1..21: mol_type = other RNA
ggccgctgcgcccggcgctgg

SEQ ID NO: 13371 - RNA, 21 nt, synthetic construct
  misc_feature 1..21: note = derived and/or modified sequence opt1 from anti-HIV_CDR
  source 1..21: mol_type = other RNA
cgcttcctgttcgtggtcgcc

SEQ ID NO: 13372 - RNA, 21 nt, synthetic construct
  misc_feature 1..21: note = derived and/or modified sequence opt1 from anti-HIV_CDR
  source 1..21: mol_type = other RNA
atgagcgtgtccttcctgatc

SEQ ID NO: 13373 - RNA, 21 nt, synthetic construct
  misc_feature 1..21: note = derived and/or modified sequence opt1 from anti-HIV_CDR
  source 1..21: mol_type = other RNA
ggcagctccaaccgctgcccc

SEQ ID NO: 13374 - RNA, 21 nt, synthetic construct
  misc_feature 1..21: note = derived and/or modified sequence opt1 from anti-HIV_CDR
  source 1..21: mol_type = other RNA
atgaagcacctgtggttcttc

SEQ ID NO: 13375 - RNA, 21 nt, synthetic construct
  misc_feature 1..21: note = derived and/or modified sequence opt1 from anti-HIV_CDR
  source 1..21: mol_type = other RNA
gccagctgggacttcgacttc

SEQ ID NO: 13376 - RNA, 21 nt, synthetic construct
  misc_feature 1..21: note = derived and/or modified sequence opt1 from anti-HIV_CDR
  source 1..21: mol_type = other RNA
gagatcggcgtggccgagcac

SEQ ID NO: 13377 - RNA, 21 nt, synthetic construct
  misc_feature 1..21: note = derived and/or modified sequence opt1 from anti-HIV_CDR
  source 1..21: mol_type = other RNA
cagaagtacgacaccgccccc

SEQ ID NO: 13378 - RNA, 21 nt, synthetic construct
  misc_feature 1..21: note = derived and/or modified sequence opt1 from anti-HIV_CDR
  source 1..21: mol_type = other RNA
cagcagagctccagcaccccc

SEQ ID NO: 13379 - RNA, 21 nt, synthetic construct
  misc_feature 1..21: note = derived and/or modified sequence opt1 from anti-HIV_CDR
  source 1..21: mol_type = other RNA
cagcagagcgccggcaccccc

SEQ ID NO: 13380 - RNA, 21 nt, synthetic construct
  misc_feature 1..21: note = derived and/or modified sequence opt1 from anti-HIV_CDR
  source 1..21: mol_type = other RNA
cagcagagctccagcaagccc

SEQ ID NO: 13381 - RNA, 21 nt, synthetic construct
  misc_feature 1..21: note = derived and/or modified sequence opt1 from anti-HIV_CDR
  source 1..21: mol_type = other RNA
caggagtacaacacctacacc

SEQ ID NO: 13382 - RNA, 21 nt, synthetic construct
  misc_feature 1..21: note = derived and/or modified sequence opt1 from anti-HIV_CDR
  source 1..21: mol_type = other RNA
caggagtacaacaactacaac

SEQ ID NO: 13383 - RNA, 21 nt, synthetic construct
  misc_feature 1..21: note = derived and/or modified sequence opt1 from anti-HIV_CDR
  source 1..21: mol_type = other RNA
cactacgacgccctggactac

SEQ ID NO: 13384 - RNA, 24 nt, synthetic construct
  misc_feature 1..24: note = derived and/or modified sequence opt1 from anti-HIV_CDR
  source 1..24: mol_type = other RNA
gccatcttcaagggcgtgcagtgc

SEQ ID NO: 13385 - RNA, 24 nt, synthetic construct
  misc_feature 1..24: note = derived and/or modified sequence opt1 from anti-HIV_CDR
  source 1..24: mol_type = other RNA
ggccccctgggggactacgacttc

SEQ ID NO: 13386 - RNA, 24 nt, synthetic construct
  misc_feature 1..24: note = derived and/or modified sequence opt1 from anti-HIV_CDR
  source 1..24: mol_type = other RNA
cagcagtacggcagctccctgcgc

SEQ ID NO: 13387 - RNA, 24 nt, synthetic construct
  misc_feature 1..24: note = derived and/or modified sequence opt1 from anti-HIV_CDR
  source 1..24: mol_type = other RNA
cagcagtacagccactaccgcacc

SEQ ID NO: 13388 - RNA, 24 nt, synthetic construct
  misc_feature 1..24: note = derived and/or modified sequence opt1 from anti-HIV_CDR
  source 1..24: mol_type = other RNA
cagtactacggcatgagcgtgacc

SEQ ID NO: 13389 - RNA, 24 nt, synthetic construct
  misc_feature 1..24: note = derived and/or modified sequence opt1 from anti-HIV_CDR
  source 1..24: mol_type = other RNA
cagcagtacgagaactggctgacc

SEQ ID NO: 13390 - RNA, 24 nt, synthetic construct
  misc_feature 1..24: note = derived and/or modified sequence opt1 from anti-HIV_CDR
  source 1..24: mol_type = other RNA
agcggcgtgcactacatggacgtc

SEQ ID NO: 13391 - RNA, 24 nt, synthetic construct
  misc_feature 1..24: note = derived and/or modified sequence opt1 from anti-HIV_CDR
  source 1..24: mol_type = other RNA
cagcagtacagcggccccctgacc

SEQ ID NO: 13392 - RNA, 24 nt, synthetic construct
  misc_feature 1..24: note = derived and/or modified sequence opt1 from anti-HIV_CDR
  source 1..24: mol_type = other RNA
cagcagtactacaccgtgcccagc

SEQ ID NO: 13393 - RNA, 24 nt, synthetic construct
  misc_feature 1..24: note = derived and/or modified sequence opt1 from anti-HIV_CDR
  source 1..24: mol_type = other RNA
cagcagtacggcagctccatcacc

SEQ ID NO: 13394 - RNA, 24 nt, synthetic construct
  misc_feature 1..24: note = derived and/or modified sequence opt1 from anti-HIV_CDR
  source 1..24: mol_type = other RNA
caccagtacaacaagtgggacacc

SEQ ID NO: 13395 - RNA, 24 nt, synthetic construct
  misc_feature 1..24: note = derived and/or modified sequence opt1 from anti-HIV_CDR
  source 1..24: mol_type = other RNA
cagcagagctacaccacccccctg

SEQ ID NO: 13396 - RNA, 24 nt, synthetic construct
  misc_feature 1..24: note = derived and/or modified sequence opt1 from anti-HIV_CDR
  source 1..24: mol_type = other RNA
cagcgctgggagaccatcgactac

SEQ ID NO: 13397 - RNA, 24 nt, synthetic construct
  misc_feature 1..24: note = derived and/or modified sequence opt1 from anti-HIV_CDR
  source 1..24: mol_type = other RNA
tgcagctacgccggctcctacacc

SEQ ID NO: 13398 - RNA, 24 nt, synthetic construct
  misc_feature 1..24: note = derived and/or modified sequence opt1 from anti-HIV_CDR
  source 1..24: mol_type = other RNA
cagcagtacgacaacctgcccacc

SEQ ID NO: 13399 - RNA, 24 nt, synthetic construct
  misc_feature 1..24: note = derived and/or modified sequence opt1 from anti-HIV_CDR
  source 1..24: mol_type = other RNA
cagcagtgcaccctgcccctcacc

SEQ ID NO: 13400 - RNA, 24 nt, synthetic construct
  misc_feature 1..24: note = derived and/or modified sequence opt1 from anti-HIV_CDR
  source 1..24: mol_type = other RNA
cagcagagctactccagcgtgacc

SEQ ID NO: 13401 - RNA, 24 nt, synthetic construct
  misc_feature 1..24: note = derived and/or modified sequence opt1 from anti-HIV_CDR
  source 1..24: mol_type = other RNA
cagcagagccacacctccgtgacc

SEQ ID NO: 13402 - RNA, 24 nt, synthetic construct
  misc_feature 1..24: note = derived and/or modified sequence opt1 from anti-HIV_CDR
  source 1..24: mol_type = other RNA
cagcagacctacgccagcgtgacc

SEQ ID NO: 13403 - RNA, 24 nt, synthetic construct
  misc_feature 1..24: note = derived and/or modified sequence opt1 from anti-HIV_CDR
  source 1..24: mol_type = other RNA
cagcagtacaacagcgactacacc

SEQ ID NO: 13404 - RNA, 24 nt, synthetic construct
  misc_feature 1..24: note = derived and/or modified sequence opt1 from anti-HIV_CDR
  source 1..24: mol_type = other RNA
cacctgtacgtgagccgccccgtc

SEQ ID NO: 13405 - RNA, 24 nt, synthetic construct
  misc_feature 1..24: note = derived and/or modified sequence opt1 from anti-HIV_CDR
  source 1..24: mol_type = other RNA
cagcagtacggccgcagccccctg

SEQ ID NO: 13406 - RNA, 24 nt, synthetic construct
  misc_feature 1..24: note = derived and/or modified sequence opt1 from anti-HIV_CDR
  source 1..24: mol_type = other RNA
cagcagtacggctccagccccctg

SEQ ID NO: 13407 - RNA, 24 nt, synthetic construct
  misc_feature 1..24: note = derived and/or modified sequence opt1 from anti-HIV_CDR
  source 1..24: mol_type = other RNA
cagcagtacaacgactggcccgcc

SEQ ID NO: 13408 - RNA, 24 nt, synthetic construct
  misc_feature 1..24: note = derived and/or modified sequence opt1 from anti-HIV_CDR
  source 1..24: mol_type = other RNA
caccagtacggcagctcccagcgc

SEQ ID NO: 13409 - RNA, 24 nt, synthetic construct
  misc_feature 1..24: note = derived and/or modified sequence opt1 from anti-HIV_CDR
  source 1..24: mol_type = other RNA
cagcagacctacagctccgtgacc

SEQ ID NO: 13410 - RNA, 24 nt, synthetic construct
  misc_feature 1..24: note = derived and/or modified sequence opt1 from anti-HIV_CDR
  source 1..24: mol_type = other RNA
cagcagacctaccgcagcgtgacc

SEQ ID NO: 13411 - RNA, 24 nt, synthetic construct
  misc_feature 1..24: note = derived and/or modified sequence opt1 from anti-HIV_CDR
  source 1..24: mol_type = other RNA
cagcagtacggcagctcctggacc

SEQ ID NO: 13412 - RNA, 24 nt, synthetic construct
  misc_feature 1..24: note = derived and/or modified sequence opt1 from anti-HIV_CDR
  source 1..24: mol_type = other RNA
agctcctacgccggcatcaacaac

SEQ ID NO: 13413 - RNA, 24 nt, synthetic construct
  misc_feature 1..24: note = derived and/or modified sequence opt1 from anti-HIV_CDR
  source 1..24: mol_type = other RNA
cagaagtacggcagctccctgacc

SEQ ID NO: 13414 - RNA, 24 nt, synthetic construct
  misc_feature 1..24: note = derived and/or modified sequence opt1 from anti-HIV_CDR
  source 1..24: mol_type = other RNA
atgcaggccctggagaccctcggc

SEQ ID NO: 13415 - RNA, 24 nt, synthetic construct
  misc_feature 1..24: note = derived and/or modified sequence opt1 from anti-HIV_CDR
  source 1..24: mol_type = other RNA
cagcagtacgccggcagcctgacc

SEQ ID NO: 13416 - RNA, 24 nt, synthetic construct
  misc_feature 1..24: note = derived and/or modified sequence opt1 from anti-HIV_CDR
  source 1..24: mol_type = other RNA
cgcaactggggcaacttcgaccac

SEQ ID NO: 13417 - RNA, 27 nt, synthetic construct
  misc_feature 1..27: note = derived and/or modified sequence opt1 from anti-HIV_CDR
  source 1..27: mol_type = other RNA
cagcagcactacaccaccccctggacg

SEQ ID NO: 13418 - RNA, 27 nt, synthetic construct
  misc_feature 1..27: note = derived and/or modified sequence opt1 from anti-HIV_CDR
  source 1..27: mol_type = other RNA
cagcagagcttcgccgtgccctacacc

SEQ ID NO: 13419 - RNA, 27 nt, synthetic construct
  misc_feature 1..27: note = derived and/or modified sequence opt1 from anti-HIV_CDR
  source 1..27: mol_type = other RNA
cagcagtacaagagctactccggcacc

SEQ ID NO: 13420 - RNA, 27 nt, synthetic construct
  misc_feature 1..27: note = derived and/or modified sequence opt1 from anti-HIV_CDR
  source 1..27: mol_type = other RNA
caccagtacgcctacagcccccgcacc

SEQ ID NO: 13421 - RNA, 27 nt, synthetic construct
  misc_feature 1..27: note = derived and/or modified sequence opt1 from anti-HIV_CDR
  source 1..27: mol_type = other RNA
cagcagtacaacagcttcccgcccacc

SEQ ID NO: 13422 - RNA, 27 nt, synthetic construct
  misc_feature 1..27: note = derived and/or modified sequence opt1 from anti-HIV_CDR
  source 1..27: mol_type = other RNA
cagcagacctacagcaacccccgcatg

SEQ ID NO: 13423 - RNA, 27 nt, synthetic construct
  misc_feature 1..27: note = derived and/or modified sequence opt1 from anti-HIV_CDR
  source 1..27: mol_type = other RNA
cagcagtacgaggacccgccctggacc

SEQ ID NO: 13424 - RNA, 27 nt, synthetic construct
  misc_feature 1..27: note = derived and/or modified sequence opt1 from anti-HIV_CDR
  source 1..27: mol_type = other RNA
caccagtacttcaacaccccccgcacc

SEQ ID NO: 13425 - RNA, 27 nt, synthetic construct
  misc_feature 1..27: note = derived and/or modified sequence opt1 from anti-HIV_CDR
  source 1..27: mol_type = other RNA
caccagtacttcagcaccccccgcacc

SEQ ID NO: 13426 - RNA, 27 nt, synthetic construct
  misc_feature 1..27: note = derived and/or modified sequence opt1 from anti-HIV_CDR
  source 1..27: mol_type = other RNA
cagcaccgcagcaactggccctggacc

SEQ ID NO: 13427 - RNA, 27 nt, synthetic construct
  misc_feature 1..27: note = derived and/or modified sequence opt1 from anti-HIV_CDR
  source 1..27: mol_type = other RNA
cgcggccggcgccagatcggggactac

SEQ ID NO: 13428 - RNA, 27 nt, synthetic construct
  misc_feature 1..27: note = derived and/or modified sequence opt1 from anti-HIV_CDR
  source 1..27: mol_type = other RNA
cagcagtacggcctgagcccctggacc

SEQ ID NO: 13429 - RNA, 27 nt, synthetic construct
  misc_feature 1..27: note = derived and/or modified sequence opt1 from anti-HIV_CDR
  source 1..27: mol_type = other RNA
cagcagacctacaccagccccatcacg

SEQ ID NO: 13430 - RNA, 27 nt, synthetic construct
  misc_feature 1..27: note = derived and/or modified sequence opt1 from anti-HIV_CDR
  source 1..27: mol_type = other RNA
cagcagtacggcagctccccgcccacc

SEQ ID NO: 13431 - RNA, 27 nt, synthetic construct
  misc_feature 1..27: note = derived and/or modified sequence opt1 from anti-HIV_CDR
  source 1..27: mol_type = other RNA
cagcagtacggcaccagctcctgcacc

SEQ ID NO: 13432 - RNA, 27 nt, synthetic construct
  misc_feature 1..27: note = derived and/or modified sequence opt1 from anti-HIV_CDR
  source 1..27: mol_type = other RNA
cagcagtacgacgacgcccccatcacc

SEQ ID NO: 13433 - RNA, 27 nt, synthetic construct
  misc_feature 1..27: note = derived and/or modified sequence opt1 from anti-HIV_CDR
  source 1..27: mol_type = other RNA
ggccccctgctccgctacctggacagc

SEQ ID NO: 13434 - RNA, 27 nt, synthetic construct
  misc_feature 1..27: note = derived and/or modified sequence opt1 from anti-HIV_CDR
  source 1..27: mol_type = other RNA
tgcctgaagaagaccagctcctacgtg

SEQ ID NO: 13435 - RNA, 27 nt, synthetic construct
  misc_feature 1..27: note = derived and/or modified sequence opt1 from anti-HIV_CDR
  source 1..27: mol_type = other RNA
cagcagtacaaccactggccccagacc

SEQ ID NO: 13436 - RNA, 27 nt, synthetic construct
  misc_feature 1..27: note = derived and/or modified sequence opt1 from anti-HIV_CDR
  source 1..27: mol_type = other RNA
cagcagtacagcaacctgccctacacc

SEQ ID NO: 13437 - RNA, 27 nt, synthetic construct
  misc_feature 1..27: note = derived and/or modified sequence opt1 from anti-HIV_CDR
  source 1..27: mol_type = other RNA
cagcagtacgacacctaccccggcacc

SEQ ID NO: 13438 - RNA, 27 nt, synthetic construct
  misc_feature 1..27: note = derived and/or modified sequence opt1 from anti-HIV_CDR
  source 1..27: mol_type = other RNA
caggagtacagctccaccccctacaac

SEQ ID NO: 13439 - RNA, 27 nt, synthetic construct
  misc_feature 1..27: note = derived and/or modified sequence opt1 from anti-HIV_CDR
  source 1..27: mol_type = other RNA
ggcgcctgggacgacaccctgtacgtg

SEQ ID NO: 13440 - RNA, 27 nt, synthetic construct
  misc_feature 1..27: note = derived and/or modified sequence opt1 from anti-HIV_CDR
  source 1..27: mol_type = other RNA
gccgcctgggacgacaccctgtacgtg

SEQ ID NO: 13441 - RNA, 27 nt, synthetic construct
  misc_feature 1..27: note = derived and/or modified sequence opt1 from anti-HIV_CDR
  source 1..27: mol_type = other RNA
cagcagtactacagcgactccatcacc

SEQ ID NO: 13442 - RNA, 27 nt, synthetic construct
  misc_feature 1..27: note = derived and/or modified sequence opt1 from anti-HIV_CDR
  source 1..27: mol_type = other RNA
cagcagtacggccgcagcccctacacc

SEQ ID NO: 13443 - RNA, 27 nt, synthetic construct
  misc_feature 1..27: note = derived and/or modified sequence opt1 from anti-HIV_CDR
  source 1..27: mol_type = other RNA
cagcagtacaccaactacccctggacc

SEQ ID NO: 13444 - RNA, 27 nt, synthetic construct
  misc_feature 1..27: note = derived and/or modified sequence opt1 from anti-HIV_CDR
  source 1..27: mol_type = other RNA
cagcagcgccacaactggcccatcagc

SEQ ID NO: 13445 - RNA, 27 nt, synthetic construct
  misc_feature 1..27: note = derived and/or modified sequence opt1 from anti-HIV_CDR
  source 1..27: mol_type = other RNA
cagcagtaccacaactggccccgcacc

SEQ ID NO: 13446 - RNA, 27 nt, synthetic construct
  misc_feature 1..27: note = derived and/or modified sequence opt1 from anti-HIV_CDR
  source 1..27: mol_type = other RNA
cagcagcgcagcacctggcccccgacc

SEQ ID NO: 13447 - RNA, 27 nt, synthetic construct
  misc_feature 1..27: note = derived and/or modified sequence opt1 from anti-HIV_CDR
  source 1..27: mol_type = other RNA
cagcagtacgacagcttctcctggacc

SEQ ID NO: 13448 - RNA, 27 nt, synthetic construct
  misc_feature 1..27: note = derived and/or modified sequence opt1 from anti-HIV_CDR
  source 1..27: mol_type = other RNA
cagcagtacaacaacctgcccgtgacc

SEQ ID NO: 13449 - RNA, 27 nt, synthetic construct
  misc_feature 1..27: note = derived and/or modified sequence opt1 from anti-HIV_CDR
  source 1..27: mol_type = other RNA
cagcagtacaaccgctacagctacacc

SEQ ID NO: 13450 - RNA, 27 nt, synthetic construct
  misc_feature 1..27: note = derived and/or modified sequence opt1 from anti-HIV_CDR
  source 1..27: mol_type = other RNA
caggagtactacatcctgccctgcagc

SEQ ID NO: 13451 - RNA, 27 nt, synthetic construct
  misc_feature 1..27: note = derived and/or modified sequence opt1 from anti-HIV_CDR
  source 1..27: mol_type = other RNA
cagcagtacgacaacctgctcgcccac

SEQ ID NO: 13452 - RNA, 27 nt, synthetic construct
  misc_feature 1..27: note = derived and/or modified sequence opt1 from anti-HIV_CDR
  source 1..27: mol_type = other RNA
caccagtgcgacaacctgatcgcccgc

SEQ ID NO: 13453 - RNA, 27 nt, synthetic construct
  misc_feature 1..27: note = derived and/or modified sequence opt1 from anti-HIV_CDR
  source 1..27: mol_type = other RNA
cagcagagcttctccaccctgtggacc

SEQ ID NO: 13454 - RNA, 27 nt, synthetic construct
  misc_feature 1..27: note = derived and/or modified sequence opt1 from anti-HIV_CDR
  source 1..27: mol_type = other RNA
caccagagctactccaccccgcccacc

SEQ ID NO: 13455 - RNA, 27 nt, synthetic construct
  misc_feature 1..27: note = derived and/or modified sequence opt1 from anti-HIV_CDR
  source 1..27: mol_type = other RNA
cagcagggctacagcaccccctggacc

SEQ ID NO: 13456 - RNA, 27 nt, synthetic construct
  misc_feature 1..27: note = derived and/or modified sequence opt1 from anti-HIV_CDR
  source 1..27: mol_type = other RNA
cagcagtacagcaccacgccccgcacc

SEQ ID NO: 13457 - RNA, 27 nt, synthetic construct
  misc_feature 1..27: note = derived and/or modified sequence opt1 from anti-HIV_CDR
  source 1..27: mol_type = other RNA
cagctgtacaacagcgtgccccagacc

SEQ ID NO: 13458 - RNA, 27 nt, synthetic construct
  misc_feature 1..27: note = derived and/or modified sequence opt1 from anti-HIV_CDR
  source 1..27: mol_type = other RNA
cagcagcgcaccagctggccccagacc

SEQ ID NO: 13459 - RNA, 27 nt, synthetic construct
  misc_feature 1..27: note = derived and/or modified sequence opt1 from anti-HIV_CDR
  source 1..27: mol_type = other RNA
cagcagttcaacacctacagccagacc

SEQ ID NO: 13460 - RNA, 27 nt, synthetic construct
  misc_feature 1..27: note = derived and/or modified sequence opt1 from anti-HIV_CDR
  source 1..27: mol_type = other RNA
atgcagagcctgcagacccccatcacc

SEQ ID NO: 13461 - RNA, 27 nt, synthetic construct
  misc_feature 1..27: note = derived and/or modified sequence opt1 from anti-HIV_CDR
  source 1..27: mol_type = other RNA
cagcagtacaacagctaccccctgacc

SEQ ID NO: 13462 - RNA, 27 nt, synthetic construct
  misc_feature 1..27: note = derived and/or modified sequence opt1 from anti-HIV_CDR
  source 1..27: mol_type = other RNA
cagcagtacaacagctactccggcacc

SEQ ID NO: 13463 - RNA, 27 nt, synthetic construct
  misc_feature 1..27: note = derived and/or modified sequence opt1 from anti-HIV_CDR
  source 1..27: mol_type = other RNA
cagagctacgactccagcctgtccggc

SEQ ID NO: 13464 - RNA, 27 nt, synthetic construct
  misc_feature 1..27: note = derived and/or modified sequence opt1 from anti-HIV_CDR
  source 1..27: mol_type = other RNA
agccagggcaacaccgccatcgactac

SEQ ID NO: 13465 - RNA, 27 nt, synthetic construct
  misc_feature 1..27: note = derived and/or modified sequence opt1 from anti-HIV_CDR
  source 1..27: mol_type = other RNA
gaggagccccgcgacgccttcgacctg

SEQ ID NO: 13466 - RNA, 27 nt, synthetic construct
  misc_feature 1..27: note = derived and/or modified sequence opt1 from anti-HIV_CDR
  source 1..27: mol_type = other RNA
cagcagagctacaccacccccgtgacg

SEQ ID NO: 13467 - RNA, 27 nt, synthetic construct
  misc_feature 1..27: note = derived and/or modified sequence opt1 from anti-HIV_CDR
  source 1..27: mol_type = other RNA
gccggccgcgaggggtggttcgacccc

SEQ ID NO: 13468 - RNA, 27 nt, synthetic construct
  misc_feature 1..27: note = derived and/or modified sequence opt1 from anti-HIV_CDR
  source 1..27: mol_type = other RNA
cagcagtactacagcaccccccacacc

SEQ ID NO: 13469 - RNA, 27 nt, synthetic construct
  misc_feature 1..27: note = derived and/or modified sequence opt1 from anti-HIV_CDR
  source 1..27: mol_type = other RNA
cagcagagctactccatcgccggcacc

SEQ ID NO: 13470 - RNA, 27 nt, synthetic construct
  misc_feature 1..27: note = derived and/or modified sequence opt1 from anti-HIV_CDR
  source 1..27: mol_type = other RNA
cagaactacaacaagcccccgcgcacc

SEQ ID NO: 13471 - RNA, 27 nt, synthetic construct
  misc_feature 1..27: note = derived and/or modified sequence opt1 from anti-HIV_CDR
  source 1..27: mol_type = other RNA
atgcagagcatccagctgcccctcacc

SEQ ID NO: 13472 - RNA, 27 nt, synthetic construct
  misc_feature 1..27: note = derived and/or modified sequence opt1 from anti-HIV_CDR
  source 1..27: mol_type = other RNA
atgcaggccctgcagaccagcctcacc

SEQ ID NO: 13473 - RNA, 27 nt, synthetic construct
  misc_feature 1..27: note = derived and/or modified sequence opt1 from anti-HIV_CDR
  source 1..27: mol_type = other RNA
cagcagtacagctccagcccccgcacc

SEQ ID NO: 13474 - RNA, 27 nt, synthetic construct
  misc_feature 1..27: note = derived and/or modified sequence opt1 from anti-HIV_CDR
  source 1..27: mol_type = other RNA
caggcctgggacagctccaccgccgtg

SEQ ID NO: 13475 - RNA, 27 nt, synthetic construct
  misc_feature 1..27: note = derived and/or modified sequence opt1 from anti-HIV_CDR
  source 1..27: mol_type = other RNA
cagcactacaacaactggccctacacc

SEQ ID NO: 13476 - RNA, 27 nt, synthetic construct
  misc_feature 1..27: note = derived and/or modified sequence opt1 from anti-HIV_CDR
  source 1..27: mol_type = other RNA
cagcagtacgaccgcctgcccatcacc

SEQ ID NO: 13477 - RNA, 27 nt, synthetic construct
  misc_feature 1..27: note = derived and/or modified sequence opt1 from anti-HIV_CDR
  source 1..27: mol_type = other RNA
cagcagtacggcagctcccccatcacc

SEQ ID NO: 13478 - RNA, 27 nt, synthetic construct
  misc_feature 1..27: note = derived and/or modified sequence opt1 from anti-HIV_CDR
  source 1..27: mol_type = other RNA
cagcagtacgacgtgtggcccctgacc

SEQ ID NO: 13479 - RNA, 27 nt, synthetic construct
  misc_feature 1..27: note = derived and/or modified sequence opt1 from anti-HIV_CDR
  source 1..27: mol_type = other RNA
caccagtacgcctccagcccccgcacc

SEQ ID NO: 13480 - RNA, 27 nt, synthetic construct
  misc_feature 1..27: note = derived and/or modified sequence opt1 from anti-HIV_CDR
  source 1..27: mol_type = other RNA
atgcagagcctgcacctcccctacacc

SEQ ID NO: 13481 - RNA, 27 nt, synthetic construct
  misc_feature 1..27: note = derived and/or modified sequence opt1 from anti-HIV_CDR
  source 1..27: mol_type = other RNA
cagcagtactactccagccccctgacc

SEQ ID NO: 13482 - RNA, 27 nt, synthetic construct
  misc_feature 1..27: note = derived and/or modified sequence opt1 from anti-HIV_CDR
  source 1..27: mol_type = other RNA
cagcagcacgacaccttccccttcacc

SEQ ID NO: 13483 - RNA, 27 nt, synthetic construct
  misc_feature 1..27: note = derived and/or modified sequence opt1 from anti-HIV_CDR
  source 1..27: mol_type = other RNA
cagcagagctactccaccccctacacc

SEQ ID NO: 13484 - RNA, 27 nt, synthetic construct
  misc_feature 1..27: note = derived and/or modified sequence opt1 from anti-HIV_CDR
  source 1..27: mol_type = other RNA
cagcagtacaagacctaccccgtgacc

SEQ ID NO: 13485 - RNA, 27 nt, synthetic construct
  misc_feature 1..27: note = derived and/or modified sequence opt1 from anti-HIV_CDR
  source 1..27: mol_type = other RNA
cagcagtactacagcacccccgtgacc

SEQ ID NO: 13486 - RNA, 27 nt, synthetic construct
  misc_feature 1..27: note = derived and/or modified sequence opt1 from anti-HIV_CDR
  source 1..27: mol_type = other RNA
cagcagtacaactggcccccgttcacc

SEQ ID NO: 13487 - RNA, 27 nt, synthetic construct
  misc_feature 1..27: note = derived and/or modified sequence opt1 from anti-HIV_CDR
  source 1..27: mol_type = other RNA
atgcagggcacccactggccctggacc

SEQ ID NO: 13488 - RNA, 27 nt, synthetic construct
  misc_feature 1..27: note = derived and/or modified sequence opt1 from anti-HIV_CDR
  source 1..27: mol_type = other RNA
caccagtgcggctccagcccccgcacc

SEQ ID NO: 13489 - RNA, 27 nt, synthetic construct
  misc_feature 1..27: note = derived and/or modified sequence opt1 from anti-HIV_CDR
  source 1..27: mol_type = other RNA
cagcagtacaacagctacttccgcacc

SEQ ID NO: 13490 - RNA, 27 nt, synthetic construct
  misc_feature 1..27: note = derived and/or modified sequence opt1 from anti-HIV_CDR
  source 1..27: mol_type = other RNA
cagcagtaccacaactggcccccgagc

SEQ ID NO: 13491 - RNA, 27 nt, synthetic construct
  misc_feature 1..27: note = derived and/or modified sequence opt1 from anti-HIV_CDR
  source 1..27: mol_type = other RNA
atgcagggcacctactggctgtggacc

SEQ ID NO: 13492 - RNA, 27 nt, synthetic construct
  misc_feature 1..27: note = derived and/or modified sequence opt1 from anti-HIV_CDR
  source 1..27: mol_type = other RNA
cagcagggcttcagcgcccccttcacc

SEQ ID NO: 13493 - RNA, 27 nt, synthetic construct
  misc_feature 1..27: note = derived and/or modified sequence opt1 from anti-HIV_CDR
  source 1..27: mol_type = other RNA
cagcagtacaacacctaccccctgacc

SEQ ID NO: 13494 - RNA, 27 nt, synthetic construct
  misc_feature 1..27: note = derived and/or modified sequence opt1 from anti-HIV_CDR
  source 1..27: mol_type = other RNA
atgcagggcacccactggccccgcacc

SEQ ID NO: 13495 - RNA, 27 nt, synthetic construct
  misc_feature 1..27: note = derived and/or modified sequence opt1 from anti-HIV_CDR
  source 1..27: mol_type = other RNA
ttcggccgcaccccctggttcgacccg

SEQ ID NO: 13496 - RNA, 27 nt, synthetic construct
  misc_feature 1..27: note = derived and/or modified sequence opt1 from anti-HIV_CDR
  source 1..27: mol_type = other RNA
cagcagtacttcaccagcgtgatcacc

SEQ ID NO: 13497 - RNA, 27 nt, synthetic construct
  misc_feature 1..27: note = derived and/or modified sequence opt1 from anti-HIV_CDR
  source 1..27: mol_type = other RNA
caccactacatgagcgacctgcagacc

SEQ ID NO: 13498 - RNA, 27 nt, synthetic construct
  misc_feature 1..27: note = derived and/or modified sequence opt1 from anti-HIV_CDR
  source 1..27: mol_type = other RNA
caccactacagctccagctcccacacc

SEQ ID NO: 13499 - RNA, 27 nt, synthetic construct
  misc_feature 1..27: note = derived and/or modified sequence opt1 from anti-HIV_CDR
  source 1..27: mol_type = other RNA
caccactacaagagcgactgccagacc

SEQ ID NO: 13500 - RNA, 27 nt, synthetic construct
  misc_feature 1..27: note = derived and/or modified sequence opt1 from anti-HIV_CDR
  source 1..27: mol_type = other RNA
cagcaccgcagctcctggcccctgacc

SEQ ID NO: 13501 - RNA, 27 nt, synthetic construct
  misc_feature 1..27: note = derived and/or modified sequence opt1 from anti-HIV_CDR
  source 1..27: mol_type = other RNA
ctgcagcaccacagctacccctggacc

SEQ ID NO: 13502 - RNA, 27 nt, synthetic construct
  misc_feature 1..27: note = derived and/or modified sequence opt1 from anti-HIV_CDR
  source 1..27: mol_type = other RNA
cagcagtacggcaccagccccgggacc

SEQ ID NO: 13503 - RNA, 27 nt, synthetic construct
  misc_feature 1..27: note = derived and/or modified sequence opt1 from anti-HIV_CDR
  source 1..27: mol_type = other RNA
cagcagtacggcagctcccccaccacc

SEQ ID NO: 13504 - RNA, 27 nt, synthetic construct
  misc_feature 1..27: note = derived and/or modified sequence opt1 from anti-HIV_CDR
  source 1..27: mol_type = other RNA
cagcagtacggcaccagccccaccacg

SEQ ID NO: 13505 - RNA, 27 nt, synthetic construct
  misc_feature 1..27: note = derived and/or modified sequence opt1 from anti-HIV_CDR
  source 1..27: mol_type = other RNA
atgcaggccacccactggcccccgggc

SEQ ID NO: 13506 - RNA, 27 nt, synthetic construct
  misc_feature 1..27: note = derived and/or modified sequence opt1 from anti-HIV_CDR
  source 1..27: mol_type = other RNA
cagcgctacaaccgggacccctacatc

SEQ ID NO: 13507 - RNA, 27 nt, synthetic construct
  misc_feature 1..27: note = derived and/or modified sequence opt1 from anti-HIV_CDR
  source 1..27: mol_type = other RNA
cagcagtacgacaacctgcccctcgcc

SEQ ID NO: 13508 - RNA, 27 nt, synthetic construct
  misc_feature 1..27: note = derived and/or modified sequence opt1 from anti-HIV_CDR
  source 1..27: mol_type = other RNA
agctcctacagcgccaccggcgtggcc

SEQ ID NO: 13509 - RNA, 27 nt, synthetic construct
  misc_feature 1..27: note = derived and/or modified sequence opt1 from anti-HIV_CDR
  source 1..27: mol_type = other RNA
cagcactacggcaacagccgctggacc

SEQ ID NO: 13510 - RNA, 27 nt, synthetic construct
  misc_feature 1..27: note = derived and/or modified sequence opt1 from anti-HIV_CDR
  source 1..27: mol_type = other RNA
cagcagtacgagacctacccctggacc

SEQ ID NO: 13511 - RNA, 27 nt, synthetic construct
  misc_feature 1..27: note = derived and/or modified sequence opt1 from anti-HIV_CDR
  source 1..27: mol_type = other RNA
cagcagtacggcagctcccccagcacc

SEQ ID NO: 13512 - RNA, 27 nt, synthetic construct
  misc_feature 1..27: note = derived and/or modified sequence opt1 from anti-HIV_CDR
  source 1..27: mol_type = other RNA
cagcagagccagcgcaccccccacacc

SEQ ID NO: 13513 - RNA, 27 nt, synthetic construct
  misc_feature 1..27: note = derived and/or modified sequence opt1 from anti-HIV_CDR
  source 1..27: mol_type = other RNA
cagcagtacgacatcctgcccctcacc

SEQ ID NO: 13514 - RNA, 27 nt, synthetic construct
  misc_feature 1..27: note = derived and/or modified sequence opt1 from anti-HIV_CDR
  source 1..27: mol_type = other RNA
cagcagagcaactccagcccctggacc

SEQ ID NO: 13515 - RNA, 27 nt, synthetic construct
  misc_feature 1..27: note = derived and/or modified sequence opt1 from anti-HIV_CDR
  source 1..27: mol_type = other RNA
cagcagagctacgacaccccccgcacc

SEQ ID NO: 13516 - RNA, 27 nt, synthetic construct
  misc_feature 1..27: note = derived and/or modified sequence opt1 from anti-HIV_CDR
  source 1..27: mol_type = other RNA
cagcagttcggcagctcccccgggacc

SEQ ID NO: 13517 - RNA, 27 nt, synthetic construct
  misc_feature 1..27: note = derived and/or modified sequence opt1 from anti-HIV_CDR
  source 1..27: mol_type = other RNA
caccagtacggctccagcccccagacc

SEQ ID NO: 13518 - RNA, 27 nt, synthetic construct
  misc_feature 1..27: note = derived and/or modified sequence opt1 from anti-HIV_CDR
  source 1..27: mol_type = other RNA
caccagtacggcagcagcccccagtcc

SEQ ID NO: 13519 - RNA, 27 nt, synthetic construct
  misc_feature 1..27: note = derived and/or modified sequence opt1 from anti-HIV_CDR
  source 1..27: mol_type = other RNA
ctgcagcacaacagctaccccctcacc

SEQ ID NO: 13520 - RNA, 27 nt, synthetic construct
  misc_feature 1..27: note = derived and/or modified sequence opt1 from anti-HIV_CDR
  source 1..27: mol_type = other RNA
cagcagtacaacgactggcccatcacc

SEQ ID NO: 13521 - RNA, 27 nt, synthetic construct
  misc_feature 1..27: note = derived and/or modified sequence opt1 from anti-HIV_CDR
  source 1..27: mol_type = other RNA
cagcagaccttcaccttcccctacacg

SEQ ID NO: 13522 - RNA, 27 nt, synthetic construct
  misc_feature 1..27: note = derived and/or modified sequence opt1 from anti-HIV_CDR
  source 1..27: mol_type = other RNA
cagcagagctacaccttcccctacatc

SEQ ID NO: 13523 - RNA, 27 nt, synthetic construct
  misc_feature 1..27: note = derived and/or modified sequence opt1 from anti-HIV_CDR
  source 1..27: mol_type = other RNA
cagtactacggcagctccccctacacc

SEQ ID NO: 13524 - RNA, 27 nt, synthetic construct
  misc_feature 1..27: note = derived and/or modified sequence opt1 from anti-HIV_CDR
  source 1..27: mol_type = other RNA
cagcagagcttcggcaccccccgcacc

SEQ ID NO: 13525 - RNA, 27 nt, synthetic construct
  misc_feature 1..27: note = derived and/or modified sequence opt1 from anti-HIV_CDR
  source 1..27: mol_type = other RNA
cagcagtacaacgactggccccgcacc

SEQ ID NO: 13526 - RNA, 27 nt, synthetic construct
  misc_feature 1..27: note = derived and/or modified sequence opt1 from anti-HIV_CDR
  source 1..27: mol_type = other RNA
cagcagtacggctccagcccccgcacc

SEQ ID NO: 13527 - RNA, 27 nt, synthetic construct
  misc_feature 1..27: note = derived and/or modified sequence opt1 from anti-HIV_CDR
  source 1..27: mol_type = other RNA
ctgcagcacaaccgctacccctggacc

SEQ ID NO: 13528 - RNA, 27 nt, synthetic construct
  misc_feature 1..27: note = derived and/or modified sequence opt1 from anti-HIV_CDR
  source 1..27: mol_type = other RNA
ctgcagcacaacaactacccctggacc

SEQ ID NO: 13529 - RNA, 27 nt, synthetic construct
  misc_feature 1..27: note = derived and/or modified sequence opt1 from anti-HIV_CDR
  source 1..27: mol_type = other RNA
ctgcagtacagcacctaccccctcacc

SEQ ID NO: 13530 - RNA, 27 nt, synthetic construct
  misc_feature 1..27: note = derived and/or modified sequence opt1 from anti-HIV_CDR
  source 1..27: mol_type = other RNA
ctgcagtacaacgcctaccccctcacc

SEQ ID NO: 13531 - RNA, 27 nt, synthetic construct
  misc_feature 1..27: note = derived and/or modified sequence opt1 from anti-HIV_CDR
  source 1..27: mol_type = other RNA
cagcagtacgacagcgcccccgtgacc

SEQ ID NO: 13532 - RNA, 27 nt, synthetic construct
  misc_feature 1..27: note = derived and/or modified sequence opt1 from anti-HIV_CDR
  source 1..27: mol_type = other RNA
cagcagacctacaccttcccctacagc

SEQ ID NO: 13533 - RNA, 27 nt, synthetic construct
  misc_feature 1..27: note = derived and/or modified sequence opt1 from anti-HIV_CDR
  source 1..27: mol_type = other RNA
ggctacgacaacagcgggcccgactac

SEQ ID NO: 13534 - RNA, 27 nt, synthetic construct
  misc_feature 1..27: note = derived and/or modified sequence opt1 from anti-HIV_CDR
  source 1..27: mol_type = other RNA
cagcagtacaacaactggcccccggcc

SEQ ID NO: 13535 - RNA, 27 nt, synthetic construct
  misc_feature 1..27: note = derived and/or modified sequence opt1 from anti-HIV_CDR
  source 1..27: mol_type = other RNA
caccagtacgccctgagcccctggacc

SEQ ID NO: 13536 - RNA, 27 nt, synthetic construct
  misc_feature 1..27: note = derived and/or modified sequence opt1 from anti-HIV_CDR
  source 1..27: mol_type = other RNA
cagaagtacgacaccgaccccatgacc

SEQ ID NO: 13537 - RNA, 27 nt, synthetic construct
  misc_feature 1..27: note = derived and/or modified sequence opt1 from anti-HIV_CDR
  source 1..27: mol_type = other RNA
cagcagtacaactactaccccatcacc

SEQ ID NO: 13538 - RNA, 27 nt, synthetic construct
  misc_feature 1..27: note = derived and/or modified sequence opt1 from anti-HIV_CDR
  source 1..27: mol_type = other RNA
cagcagaccttcaccgaccccgtgacg

SEQ ID NO: 13539 - RNA, 27 nt, synthetic construct
  misc_feature 1..27: note = derived and/or modified sequence opt1 from anti-HIV_CDR
  source 1..27: mol_type = other RNA
gccgcctgggacgacagcctgcacgtg

SEQ ID NO: 13540 - RNA, 27 nt, synthetic construct
  misc_feature 1..27: note = derived and/or modified sequence opt1 from anti-HIV_CDR
  source 1..27: mol_type = other RNA
cagcagtacgccagctcccccttcacc

SEQ ID NO: 13541 - RNA, 27 nt, synthetic construct
  misc_feature 1..27: note = derived and/or modified sequence opt1 from anti-HIV_CDR
  source 1..27: mol_type = other RNA
cagcagagctccagcacccccttcacc

SEQ ID NO: 13542 - RNA, 27 nt, synthetic construct
  misc_feature 1..27: note = derived and/or modified sequence opt1 from anti-HIV_CDR
  source 1..27: mol_type = other RNA
cagcagcgcagcaactgggccatcacc

SEQ ID NO: 13543 - RNA, 27 nt, synthetic construct
  misc_feature 1..27: note = derived and/or modified sequence opt1 from anti-HIV_CDR
  source 1..27: mol_type = other RNA
cagcagtacggcagctcccccttcacc

SEQ ID NO: 13544 - RNA, 27 nt, synthetic construct
  misc_feature 1..27: note = derived and/or modified sequence opt1 from anti-HIV_CDR
  source 1..27: mol_type = other RNA
cagaagtacaacggcgccccctggacc

SEQ ID NO: 13545 - RNA, 27 nt, synthetic construct
  misc_feature 1..27: note = derived and/or modified sequence opt1 from anti-HIV_CDR
  source 1..27: mol_type = other RNA
cagaagtacaacaacgccccctggacc

SEQ ID NO: 13546 - RNA, 27 nt, synthetic construct
  misc_feature 1..27: note = derived and/or modified sequence opt1 from anti-HIV_CDR
  source 1..27: mol_type = other RNA
cagcagcgcgtgaactggcccccgaac

SEQ ID NO: 13547 - RNA, 27 nt, synthetic construct
  misc_feature 1..27: note = derived and/or modified sequence opt1 from anti-HIV_CDR
  source 1..27: mol_type = other RNA
cagcagcgcggccactggcccctgacc

SEQ ID NO: 13548 - RNA, 27 nt, synthetic construct
  misc_feature 1..27: note = derived and/or modified sequence opt1 from anti-HIV_CDR
  source 1..27: mol_type = other RNA
cagcagtaccgctacagcgtgatcatc

SEQ ID NO: 13549 - RNA, 27 nt, synthetic construct
  misc_feature 1..27: note = derived and/or modified sequence opt1 from anti-HIV_CDR
  source 1..27: mol_type = other RNA
cagcagagcggcacctccctgctcacc

SEQ ID NO: 13550 - RNA, 27 nt, synthetic construct
  misc_feature 1..27: note = derived and/or modified sequence opt1 from anti-HIV_CDR
  source 1..27: mol_type = other RNA
atgaagtcccagcacagcccccgcacc

SEQ ID NO: 13551 - RNA, 27 nt, synthetic construct
  misc_feature 1..27: note = derived and/or modified sequence opt1 from anti-HIV_CDR
  source 1..27: mol_type = other RNA
atgcagcccctgcagaccccgtacacc

SEQ ID NO: 13552 - RNA, 27 nt, synthetic construct
  misc_feature 1..27: note = derived and/or modified sequence opt1 from anti-HIV_CDR
  source 1..27: mol_type = other RNA
cagcagtacaccgcctacccctggacc

SEQ ID NO: 13553 - RNA, 27 nt, synthetic construct
  misc_feature 1..27: note = derived and/or modified sequence opt1 from anti-HIV_CDR
  source 1..27: mol_type = other RNA
ctgcagaaccacaactacccccgcacc

SEQ ID NO: 13554 - RNA, 27 nt, synthetic construct
  misc_feature 1..27: note = derived and/or modified sequence opt1 from anti-HIV_CDR
  source 1..27: mol_type = other RNA
ctgcagacccacagctacccccgcacc

SEQ ID NO: 13555 - RNA, 30 nt, synthetic construct
  misc_feature 1..30: note = derived and/or modified sequence opt1 from anti-HIV_CDR
  source 1..30: mol_type = other RNA
gccgcctgggacgacagcttcgactacgtg

SEQ ID NO: 13556 - RNA, 30 nt, synthetic construct
  misc_feature 1..30: note = derived and/or modified sequence opt1 from anti-HIV_CDR
  source 1..30: mol_type = other RNA
cagcacagcttcggctccccgccctggacc

SEQ ID NO: 13557 - RNA, 30 nt, synthetic construct
  misc_feature 1..30: note = derived and/or modified sequence opt1 from anti-HIV_CDR
  source 1..30: mol_type = other RNA
agctccttcacccccaccaacacgctggtg

SEQ ID NO: 13558 - RNA, 30 nt, synthetic construct
  misc_feature 1..30: note = derived and/or modified sequence opt1 from anti-HIV_CDR
  source 1..30: mol_type = other RNA
cagcagtacggcaccctgcacccccgcacc

SEQ ID NO: 13559 - RNA, 30 nt, synthetic construct
  misc_feature 1..30: note = derived and/or modified sequence opt1 from anti-HIV_CDR
  source 1..30: mol_type = other RNA
cagcagtacaacaactggcccccgatcacc

SEQ ID NO: 13560 - RNA, 30 nt, synthetic construct
  misc_feature 1..30: note = derived and/or modified sequence opt1 from anti-HIV_CDR
  source 1..30: mol_type = other RNA
cagcagtactaccagtggctgagctacacc

SEQ ID NO: 13561 - RNA, 30 nt, synthetic construct
  misc_feature 1..30: note = derived and/or modified sequence opt1 from anti-HIV_CDR
  source 1..30: mol_type = other RNA
cagcagcgcgccaactggcggctgctcacc

SEQ ID NO: 13562 - RNA, 30 nt, synthetic construct
  misc_feature 1..30: note = derived and/or modified sequence opt1 from anti-HIV_CDR
  source 1..30: mol_type = other RNA
cgccacagcgactactgcgacctggacgtg

SEQ ID NO: 13563 - RNA, 30 nt, synthetic construct
  misc_feature 1..30: note = derived and/or modified sequence opt1 from anti-HIV_CDR
  source 1..30: mol_type = other RNA
cgccggagcgactactgcgacttcgacgtg

SEQ ID NO: 13564 - RNA, 30 nt, synthetic construct
  misc_feature 1..30: note = derived and/or modified sequence opt1 from anti-HIV_CDR
  source 1..30: mol_type = other RNA
cgccacaccgactactgcgacttcgacgtg

SEQ ID NO: 13565 - RNA, 30 nt, synthetic construct
  misc_feature 1..30: note = derived and/or modified sequence opt1 from anti-HIV_CDR
  source 1..30: mol_type = other RNA
cagcgcagcgactactgggacttcgacgtg

SEQ ID NO: 13566 - RNA, 30 nt, synthetic construct
  misc_feature 1..30: note = derived and/or modified sequence opt1 from anti-HIV_CDR
  source 1..30: mol_type = other RNA
cgccacagcgactactgcgacttcgacatc

SEQ ID NO: 13567 - RNA, 30 nt, synthetic construct
  misc_feature 1..30: note = derived and/or modified sequence opt1 from anti-HIV_CDR
  source 1..30: mol_type = other RNA
tgcgaggtggacgccgacgagaccatcacc

SEQ ID NO: 13568 - RNA, 30 nt, synthetic construct
  misc_feature 1..30: note = derived and/or modified sequence opt1 from anti-HIV_CDR
  source 1..30: mol_type = other RNA
tgcgaggtggacgccgaggagaccatcatc

SEQ ID NO: 13569 - RNA, 30 nt, synthetic construct
  misc_feature 1..30: note = derived and/or modified sequence opt1 from anti-HIV_CDR
  source 1..30: mol_type = other RNA
cagcgcagcgacttctgggacttcgacgtg

SEQ ID NO: 13570 - RNA, 30 nt, synthetic construct
  misc_feature 1..30: note = derived and/or modified sequence opt1 from anti-HIV_CDR
  source 1..30: mol_type = other RNA
cgccacagcgactactgcgacttcgacgtg

SEQ ID NO: 13571 - RNA, 30 nt, synthetic construct
  misc_feature 1..30: note = derived and/or modified sequence opt1 from anti-HIV_CDR
  source 1..30: mol_type = other RNA
tgcagctacgccggcgggcgcaccgtggtc

SEQ ID NO: 13572 - RNA, 30 nt, synthetic construct
  misc_feature 1..30: note = derived and/or modified sequence opt1 from anti-HIV_CDR
  source 1..30: mol_type = other RNA
gccgcctgggacgacagcctggactacgtg

SEQ ID NO: 13573 - RNA, 30 nt, synthetic construct
  misc_feature 1..30: note = derived and/or modified sequence opt1 from anti-HIV_CDR
  source 1..30: mol_type = other RNA
cagcagcgcagcaactggccccggctgacc

SEQ ID NO: 13574 - RNA, 30 nt, synthetic construct
  misc_feature 1..30: note = derived and/or modified sequence opt1 from anti-HIV_CDR
  source 1..30: mol_type = other RNA
cagcagtacaacaactggcccccgttcacc

SEQ ID NO: 13575 - RNA, 30 nt, synthetic construct
  misc_feature 1..30: note = derived and/or modified sequence opt1 from anti-HIV_CDR
  source 1..30: mol_type = other RNA
atgcagggcacctactggcccccgctgacc

SEQ ID NO: 13576 - RNA, 30 nt, synthetic construct
  misc_feature 1..30: note = derived and/or modified sequence opt1 from anti-HIV_CDR
  source 1..30: mol_type = other RNA
cagcagtacggcagctccctgctctacacc

SEQ ID NO: 13577 - RNA, 30 nt, synthetic construct
  misc_feature 1..30: note = derived and/or modified sequence opt1 from anti-HIV_CDR
  source 1..30: mol_type = other RNA
cagcagagcttcggcatcccgccctggacc

SEQ ID NO: 13578 - RNA, 30 nt, synthetic construct
  misc_feature 1..30: note = derived and/or modified sequence opt1 from anti-HIV_CDR
  source 1..30: mol_type = other RNA
tgcagctacgccggctcctacagctacgtg

SEQ ID NO: 13579 - RNA, 30 nt, synthetic construct
  misc_feature 1..30: note = derived and/or modified sequence opt1 from anti-HIV_CDR
  source 1..30: mol_type = other RNA
tacagctacgccggcaactccctgggggtg

SEQ ID NO: 13580 - RNA, 30 nt, synthetic construct
  misc_feature 1..30: note = derived and/or modified sequence opt1 from anti-HIV_CDR
  source 1..30: mol_type = other RNA
tcctcctacaccatcagcagcccccgcgtg

SEQ ID NO: 13581 - RNA, 30 nt, synthetic construct
  misc_feature 1..30: note = derived and/or modified sequence opt1 from anti-HIV_CDR
  source 1..30: mol_type = other RNA
caggagtgggagctgcagcccttcgactac

SEQ ID NO: 13582 - RNA, 30 nt, synthetic construct
  misc_feature 1..30: note = derived and/or modified sequence opt1 from anti-HIV_CDR
  source 1..30: mol_type = other RNA
ctgatccccgtgagcggcgccttcgacgtc

SEQ ID NO: 13583 - RNA, 30 nt, synthetic construct
  misc_feature 1..30: note = derived and/or modified sequence opt1 from anti-HIV_CDR
  source 1..30: mol_type = other RNA
gaccgcgactacgacgaggacttcgacttc

SEQ ID NO: 13584 - RNA, 30 nt, synthetic construct
  misc_feature 1..30: note = derived and/or modified sequence opt1 from anti-HIV_CDR
  source 1..30: mol_type = other RNA
caggagtacggccgcagcccgcccttcccc

SEQ ID NO: 13585 - RNA, 30 nt, synthetic construct
  misc_feature 1..30: note = derived and/or modified sequence opt1 from anti-HIV_CDR
  source 1..30: mol_type = other RNA
accctggacggcaacttccactgggacttc

SEQ ID NO: 13586 - RNA, 30 nt, synthetic construct
  misc_feature 1..30: note = derived and/or modified sequence opt1 from anti-HIV_CDR
  source 1..30: mol_type = other RNA
ttcacccagcgccagggcgggttcgactac

SEQ ID NO: 13587 - RNA, 30 nt, synthetic construct
  misc_feature 1..30: note = derived and/or modified sequence opt1 from anti-HIV_CDR
  source 1..30: mol_type = other RNA
cagcagtactacaagtggcccccgatcacc

SEQ ID NO: 13588 - RNA, 30 nt, synthetic construct
  misc_feature 1..30: note = derived and/or modified sequence opt1 from anti-HIV_CDR
  source 1..30: mol_type = other RNA
cagcagtacggcagctccgccccctacacc

SEQ ID NO: 13589 - RNA, 30 nt, synthetic construct
  misc_feature 1..30: note = derived and/or modified sequence opt1 from anti-HIV_CDR
  source 1..30: mol_type = other RNA
cagcagctgaacagcgacccgccctggacc

SEQ ID NO: 13590 - RNA, 30 nt, synthetic construct
  misc_feature 1..30: note = derived and/or modified sequence opt1 from anti-HIV_CDR
  source 1..30: mol_type = other RNA
cagcaccacggcagctcccccacctggacc

SEQ ID NO: 13591 - RNA, 30 nt, synthetic construct
  misc_feature 1..30: note = derived and/or modified sequence opt1 from anti-HIV_CDR
  source 1..30: mol_type = other RNA
cagcagtacaagaagtggcccccgtggacc

SEQ ID NO: 13592 - RNA, 30 nt, synthetic construct
  misc_feature 1..30: note = derived and/or modified sequence opt1 from anti-HIV_CDR
  source 1..30: mol_type = other RNA
cagcagtacggcttcagcctgcccgtgacc

SEQ ID NO: 13593 - RNA, 30 nt, synthetic construct
  misc_feature 1..30: note = derived and/or modified sequence opt1 from anti-HIV_CDR
  source 1..30: mol_type = other RNA
cagagctacaacggcgacccgcccgtgacc

SEQ ID NO: 13594 - RNA, 30 nt, synthetic construct
  misc_feature 1..30: note = derived and/or modified sequence opt1 from anti-HIV_CDR
  source 1..30: mol_type = other RNA
cagcagtacggcagctcccgccggtggacc

SEQ ID NO: 13595 - RNA, 30 nt, synthetic construct
  misc_feature 1..30: note = derived and/or modified sequence opt1 from anti-HIV_CDR
  source 1..30: mol_type = other RNA
cagcagttcaacagctacccgcccctgacc

SEQ ID NO: 13596 - RNA, 30 nt, synthetic construct
  misc_feature 1..30: note = derived and/or modified sequence opt1 from anti-HIV_CDR
  source 1..30: mol_type = other RNA
cgcgagggcagccagggggccttcgacatc

SEQ ID NO: 13597 - RNA, 30 nt, synthetic construct
  misc_feature 1..30: note = derived and/or modified sequence opt1 from anti-HIV_CDR
  source 1..30: mol_type = other RNA
ggcgacagcgggcccaccggcttcgactac

SEQ ID NO: 13598 - RNA, 30 nt, synthetic construct
  misc_feature 1..30: note = derived and/or modified sequence opt1 from anti-HIV_CDR
  source 1..30: mol_type = other RNA
gtgcgccggggcagctcctaccccgactac

SEQ ID NO: 13599 - RNA, 30 nt, synthetic construct
  misc_feature 1..30: note = derived and/or modified sequence opt1 from anti-HIV_CDR
  source 1..30: mol_type = other RNA
agcgcctactaccgcaactggttcgactcc

SEQ ID NO: 13600 - RNA, 30 nt, synthetic construct
  misc_feature 1..30: note = derived and/or modified sequence opt1 from anti-HIV_CDR
  source 1..30: mol_type = other RNA
cagagctacgactccagcgtgtccgtcgtg

SEQ ID NO: 13601 - RNA, 30 nt, synthetic construct
  misc_feature 1..30: note = derived and/or modified sequence opt1 from anti-HIV_CDR
  source 1..30: mol_type = other RNA
agctcctacaccagctccctgaccctcgtg

SEQ ID NO: 13602 - RNA, 30 nt, synthetic construct
  misc_feature 1..30: note = derived and/or modified sequence opt1 from anti-HIV_CDR
  source 1..30: mol_type = other RNA
tacgagggcaagcgcagcgggatggacgtg

SEQ ID NO: 13603 - RNA, 30 nt, synthetic construct
  misc_feature 1..30: note = derived and/or modified sequence opt1 from anti-HIV_CDR
  source 1..30: mol_type = other RNA
cagcagtacggcagctcccccgagtacacc

SEQ ID NO: 13604 - RNA, 30 nt, synthetic construct
  misc_feature 1..30: note = derived and/or modified sequence opt1 from anti-HIV_CDR
  source 1..30: mol_type = other RNA
cagtactacgaccaccgccccgccatcgcc

SEQ ID NO: 13605 - RNA, 30 nt, synthetic construct
  misc_feature 1..30: note = derived and/or modified sequence opt1 from anti-HIV_CDR
  source 1..30: mol_type = other RNA
cagcagtacgacaacctgccccgcgtgacc

SEQ ID NO: 13606 - RNA, 30 nt, synthetic construct
  misc_feature 1..30: note = derived and/or modified sequence opt1 from anti-HIV_CDR
  source 1..30: mol_type = other RNA
ggcgcctacaccaccacgagcaccctggtg

SEQ ID NO: 13607 - RNA, 30 nt, synthetic construct
  misc_feature 1..30: note = derived and/or modified sequence opt1 from anti-HIV_CDR
  source 1..30: mol_type = other RNA
cagcagtacaagtcctacagccccctgacc

SEQ ID NO: 13608 - RNA, 30 nt, synthetic construct
  misc_feature 1..30: note = derived and/or modified sequence opt1 from anti-HIV_CDR
  source 1..30: mol_type = other RNA
cagcagagctacaacacccgccccctgacc

SEQ ID NO: 13609 - RNA, 30 nt, synthetic construct
  misc_feature 1..30: note = derived and/or modified sequence opt1 from anti-HIV_CDR
  source 1..30: mol_type = other RNA
cagcagtacggcgggagcccgcccgacacc

SEQ ID NO: 13610 - RNA, 30 nt, synthetic construct
  misc_feature 1..30: note = derived and/or modified sequence opt1 from anti-HIV_CDR
  source 1..30: mol_type = other RNA
tgcagctacacctccagcgccaccgtggtc

SEQ ID NO: 13611 - RNA, 30 nt, synthetic construct
  misc_feature 1..30: note = derived and/or modified sequence opt1 from anti-HIV_CDR
  source 1..30: mol_type = other RNA
tgcagccacacctccagcgacaccctggtg

SEQ ID NO: 13612 - RNA, 30 nt, synthetic construct
  misc_feature 1..30: note = derived and/or modified sequence opt1 from anti-HIV_CDR
  source 1..30: mol_type = other RNA
cagcactacggcaacagcccccgcgtgacc

SEQ ID NO: 13613 - RNA, 30 nt, synthetic construct
  misc_feature 1..30: note = derived and/or modified sequence opt1 from anti-HIV_CDR
  source 1..30: mol_type = other RNA
gacgccttcgtgagctccgccatggacgtc

SEQ ID NO: 13614 - RNA, 30 nt, synthetic construct
  misc_feature 1..30: note = derived and/or modified sequence opt1 from anti-HIV_CDR
  source 1..30: mol_type = other RNA
ctgcgcgccaccacccccggcttcgactac

SEQ ID NO: 13615 - RNA, 30 nt, synthetic construct
  misc_feature 1..30: note = derived and/or modified sequence opt1 from anti-HIV_CDR
  source 1..30: mol_type = other RNA
ctgcgcgccaccatccccggcttcgactac

SEQ ID NO: 13616 - RNA, 30 nt, synthetic construct
  misc_feature 1..30: note = derived and/or modified sequence opt1 from anti-HIV_CDR
  source 1..30: mol_type = other RNA
ctgcgcgccaccatcgccggcttcgactac

SEQ ID NO: 13617 - RNA, 30 nt, synthetic construct
  misc_feature 1..30: note = derived and/or modified sequence opt1 from anti-HIV_CDR
  source 1..30: mol_type = other RNA
tgcagctacgccggctcctacatctgggtg

SEQ ID NO: 13618 - RNA, 30 nt, synthetic construct
  misc_feature 1..30: note = derived and/or modified sequence opt1 from anti-HIV_CDR
  source 1..30: mol_type = other RNA
tgcagctacgccggcacctactcctacgtg

SEQ ID NO: 13619 - RNA, 30 nt, synthetic construct
  misc_feature 1..30: note = derived and/or modified sequence opt1 from anti-HIV_CDR
  source 1..30: mol_type = other RNA
agctcctacgccggcagcaacaacttcgtg

SEQ ID NO: 13620 - RNA, 30 nt, synthetic construct
  misc_feature 1..30: note = derived and/or modified sequence opt1 from anti-HIV_CDR
  source 1..30: mol_type = other RNA
ggcagcttcaccacctccctgacgctcgtg

SEQ ID NO: 13621 - RNA, 30 nt, synthetic construct
  misc_feature 1..30: note = derived and/or modified sequence opt1 from anti-HIV_CDR
  source 1..30: mol_type = other RNA
cagcagtacgccaccagctccctgtacacc

SEQ ID NO: 13622 - RNA, 30 nt, synthetic construct
  misc_feature 1..30: note = derived and/or modified sequence opt1 from anti-HIV_CDR
  source 1..30: mol_type = other RNA
cagtggtacggcaccctgcacccccgcacc

SEQ ID NO: 13623 - RNA, 30 nt, synthetic construct
  misc_feature 1..30: note = derived and/or modified sequence opt1 from anti-HIV_CDR
  source 1..30: mol_type = other RNA
agctcctacagctccaccaacacctacgtg

SEQ ID NO: 13624 - RNA, 30 nt, synthetic construct
  misc_feature 1..30: note = derived and/or modified sequence opt1 from anti-HIV_CDR
  source 1..30: mol_type = other RNA
accttcatcaccgccagctggttcgactcc

SEQ ID NO: 13625 - RNA, 30 nt, synthetic construct
  misc_feature 1..30: note = derived and/or modified sequence opt1 from anti-HIV_CDR
  source 1..30: mol_type = other RNA
accggcgggctgctccgcttccccgaggtg

SEQ ID NO: 13626 - RNA, 30 nt, synthetic construct
  misc_feature 1..30: note = derived and/or modified sequence opt1 from anti-HIV_CDR
  source 1..30: mol_type = other RNA
tgcagctacgccggctcctacacctacgtg

SEQ ID NO: 13627 - RNA, 30 nt, synthetic construct
  misc_feature 1..30: note = derived and/or modified sequence opt1 from anti-HIV_CDR
  source 1..30: mol_type = other RNA
cagcagcgctacagctggccctccctgacc

SEQ ID NO: 13628 - RNA, 30 nt, synthetic construct
  misc_feature 1..30: note = derived and/or modified sequence opt1 from anti-HIV_CDR
  source 1..30: mol_type = other RNA
ctgcagtgcggcagctccccgccctacacc

SEQ ID NO: 13629 - RNA, 30 nt, synthetic construct
  misc_feature 1..30: note = derived and/or modified sequence opt1 from anti-HIV_CDR
  source 1..30: mol_type = other RNA
agctcctacgccggcaccaaccactgggtg

SEQ ID NO: 13630 - RNA, 30 nt, synthetic construct
  misc_feature 1..30: note = derived and/or modified sequence opt1 from anti-HIV_CDR
  source 1..30: mol_type = other RNA
agctcctacgccgccaccaaccactgggtg

SEQ ID NO: 13631 - RNA, 30 nt, synthetic construct
  misc_feature 1..30: note = derived and/or modified sequence opt1 from anti-HIV_CDR
  source 1..30: mol_type = other RNA
cagtactacggcaccagcccgccctccacc

SEQ ID NO: 13632 - RNA, 30 nt, synthetic construct
  misc_feature 1..30: note = derived and/or modified sequence opt1 from anti-HIV_CDR
  source 1..30: mol_type = other RNA
cagtactacggcagctccccgcccagcacc

SEQ ID NO: 13633 - RNA, 30 nt, synthetic construct
  misc_feature 1..30: note = derived and/or modified sequence opt1 from anti-HIV_CDR
  source 1..30: mol_type = other RNA
caggagttcggccgcgccccgccctacccc

SEQ ID NO: 13634 - RNA, 30 nt, synthetic construct
  misc_feature 1..30: note = derived and/or modified sequence opt1 from anti-HIV_CDR
  source 1..30: mol_type = other RNA
caggagtacggccgcagcccgccctacccc

SEQ ID NO: 13635 - RNA, 30 nt, synthetic construct
  misc_feature 1..30: note = derived and/or modified sequence opt1 from anti-HIV_CDR
  source 1..30: mol_type = other RNA
caggagtacggccgcgccccgccctacccc

SEQ ID NO: 13636 - RNA, 30 nt, synthetic construct
  misc_feature 1..30: note = derived and/or modified sequence opt1 from anti-HIV_CDR
  source 1..30: mol_type = other RNA
cacatcgccgtgggcgggagcgaggagcac

SEQ ID NO: 13637 - RNA, 30 nt, synthetic construct
  misc_feature 1..30: note = derived and/or modified sequence opt1 from anti-HIV_CDR
  source 1..30: mol_type = other RNA
cacatcgccgtgggcgggagcgaggaccac

SEQ ID NO: 13638 - RNA, 30 nt, synthetic construct
  misc_feature 1..30: note = derived and/or modified sequence opt1 from anti-HIV_CDR
  source 1..30: mol_type = other RNA
cacatcgccgtgggcgggcgcgaggaggag

SEQ ID NO: 13639 - RNA, 33 nt, synthetic construct
  misc_feature 1..33: note = derived and/or modified sequence opt1 from anti-HIV_CDR
  source 1..33: mol_type = other RNA
ggcgagaagtcccgcgggagccgggccgtgcag

SEQ ID NO: 13640 - RNA, 33 nt, synthetic construct
  misc_feature 1..33: note = derived and/or modified sequence opt1 from anti-HIV_CDR
  source 1..33: mol_type = other RNA
ggcgagaagtccttcgccagccgcgccgtgcag

SEQ ID NO: 13641 - RNA, 33 nt, synthetic construct
  misc_feature 1..33: note = derived and/or modified sequence opt1 from anti-HIV_CDR
  source 1..33: mol_type = other RNA
ggccgccaggccctggggagccgggccgtgcag

SEQ ID NO: 13642 - RNA, 33 nt, synthetic construct
  misc_feature 1..33: note = derived and/or modified sequence opt1 from anti-HIV_CDR
  source 1..33: mol_type = other RNA
ggcgaggagagcctggggtcccgcagcgtgatc

SEQ ID NO: 13643 - RNA, 33 nt, synthetic construct
  misc_feature 1..33: note = derived and/or modified sequence opt1 from anti-HIV_CDR
  source 1..33: mol_type = other RNA
ggcgagaagtccctggggagccgcgccgtgcag

SEQ ID NO: 13644 - RNA, 33 nt, synthetic construct
  misc_feature 1..33: note = derived and/or modified sequence opt1 from anti-HIV_CDR
  source 1..33: mol_type = other RNA
ggcaaggagagcatcgggtcccgcgccgtgcag

SEQ ID NO: 13645 - RNA, 33 nt, synthetic construct
  misc_feature 1..33: note = derived and/or modified sequence opt1 from anti-HIV_CDR
  source 1..33: mol_type = other RNA
ggcgggaacaacatcggcagcaagtccgtgcac

SEQ ID NO: 13646 - RNA, 33 nt, synthetic construct
  misc_feature 1..33: note = derived and/or modified sequence opt1 from anti-HIV_CDR
  source 1..33: mol_type = other RNA
ggcgagaagtccatcgggagccgcgccgtgcag

SEQ ID NO: 13647 - RNA, 33 nt, synthetic construct
  misc_feature 1..33: note = derived and/or modified sequence opt1 from anti-HIV_CDR
  source 1..33: mol_type = other RNA
aaggccagccaggacgtgtccaccgccgtcgcg

SEQ ID NO: 13648 - RNA, 33 nt, synthetic construct
  misc_feature 1..33: note = derived and/or modified sequence opt1 from anti-HIV_CDR
  source 1..33: mol_type = other RNA
ggcagccgcaacctgtcccaccggctcctgagc

SEQ ID NO: 13649 - RNA, 33 nt, synthetic construct
  misc_feature 1..33: note = derived and/or modified sequence opt1 from anti-HIV_CDR
  source 1..33: mol_type = other RNA
ggcacctacgacagccaggggtccacccgcctg

SEQ ID NO: 13650 - RNA, 33 nt, synthetic construct
  misc_feature 1..33: note = derived and/or modified sequence opt1 from anti-HIV_CDR
  source 1..33: mol_type = other RNA
cagcagcgcaccatctggcccccgggctgcagc

SEQ ID NO: 13651 - RNA, 33 nt, synthetic construct
  misc_feature 1..33: note = derived and/or modified sequence opt1 from anti-HIV_CDR
  source 1..33: mol_type = other RNA
ggcacctgggacagctccctgagcgccgtgctc

SEQ ID NO: 13652 - RNA, 33 nt, synthetic construct
  misc_feature 1..33: note = derived and/or modified sequence opt1 from anti-HIV_CDR
  source 1..33: mol_type = other RNA
gccagctgggacaactccctgagcggccccgtg

SEQ ID NO: 13653 - RNA, 33 nt, synthetic construct
  misc_feature 1..33: note = derived and/or modified sequence opt1 from anti-HIV_CDR
  source 1..33: mol_type = other RNA
gccagctgggacgactccctgagcggctgggtg

SEQ ID NO: 13654 - RNA, 33 nt, synthetic construct
  misc_feature 1..33: note = derived and/or modified sequence opt1 from anti-HIV_CDR
  source 1..33: mol_type = other RNA
ctgctcctgccctactacggcgggccgtggatc

SEQ ID NO: 13655 - RNA, 33 nt, synthetic construct
  misc_feature 1..33: note = derived and/or modified sequence opt1 from anti-HIV_CDR
  source 1..33: mol_type = other RNA
cagcaccgcaccaactggcccccgagcatcacc

SEQ ID NO: 13656 - RNA, 33 nt, synthetic construct
  misc_feature 1..33: note = derived and/or modified sequence opt1 from anti-HIV_CDR
  source 1..33: mol_type = other RNA
cagagctacgaccgctccctgcggggcagcgtg

SEQ ID NO: 13657 - RNA, 33 nt, synthetic construct
  misc_feature 1..33: note = derived and/or modified sequence opt1 from anti-HIV_CDR
  source 1..33: mol_type = other RNA
agctccggcaactacgacttcgccttcgacatc

SEQ ID NO: 13658 - RNA, 33 nt, synthetic construct
  misc_feature 1..33: note = derived and/or modified sequence opt1 from anti-HIV_CDR
  source 1..33: mol_type = other RNA
agctccggcaactacgacttcgcctacgacatc

SEQ ID NO: 13659 - RNA, 33 nt, synthetic construct
  misc_feature 1..33: note = derived and/or modified sequence opt1 from anti-HIV_CDR
  source 1..33: mol_type = other RNA
agctccggcaacttcgagttcgccttcgagatc

SEQ ID NO: 13660 - RNA, 33 nt, synthetic construct
  misc_feature 1..33: note = derived and/or modified sequence opt1 from anti-HIV_CDR
  source 1..33: mol_type = other RNA
gccacctacgacagccacggctccatccgcctg

SEQ ID NO: 13661 - RNA, 33 nt, synthetic construct
  misc_feature 1..33: note = derived and/or modified sequence opt1 from anti-HIV_CDR
  source 1..33: mol_type = other RNA
ggcacctacgacaccagcctgtccctccgcctg

SEQ ID NO: 13662 - RNA, 33 nt, synthetic construct
  misc_feature 1..33: note = derived and/or modified sequence opt1 from anti-HIV_CDR
  source 1..33: mol_type = other RNA
gccgccttcgacagcgcgctgtccctccccctg

SEQ ID NO: 13663 - RNA, 33 nt, synthetic construct
  misc_feature 1..33: note = derived and/or modified sequence opt1 from anti-HIV_CDR
  source 1..33: mol_type = other RNA
gccacctacgacagcgacggctccatccgcctg

SEQ ID NO: 13664 - RNA, 33 nt, synthetic construct
  misc_feature 1..33: note = derived and/or modified sequence opt1 from anti-HIV_CDR
  source 1..33: mol_type = other RNA
gccacctacgacagcggctggtccatccgcctg

SEQ ID NO: 13665 - RNA, 33 nt, synthetic construct
  misc_feature 1..33: note = derived and/or modified sequence opt1 from anti-HIV_CDR
  source 1..33: mol_type = other RNA
gccacctacgacaccggcctgagcctccgcctg

SEQ ID NO: 13666 - RNA, 33 nt, synthetic construct
  misc_feature 1..33: note = derived and/or modified sequence opt1 from anti-HIV_CDR
  source 1..33: mol_type = other RNA
gccgcctacgacagcaccctgtccctccgcctg

SEQ ID NO: 13667 - RNA, 33 nt, synthetic construct
  misc_feature 1..33: note = derived and/or modified sequence opt1 from anti-HIV_CDR
  source 1..33: mol_type = other RNA
gccgcctacgacagcgcggtgtccctgcccgtc

SEQ ID NO: 13668 - RNA, 33 nt, synthetic construct
  misc_feature 1..33: note = derived and/or modified sequence opt1 from anti-HIV_CDR
  source 1..33: mol_type = other RNA
gccacctacgacaccgacctgagcctccgcctg

SEQ ID NO: 13669 - RNA, 33 nt, synthetic construct
  misc_feature 1..33: note = derived and/or modified sequence opt1 from anti-HIV_CDR
  source 1..33: mol_type = other RNA
gccgcctacgacagctccctgagcctccgcctg

SEQ ID NO: 13670 - RNA, 33 nt, synthetic construct
  misc_feature 1..33: note = derived and/or modified sequence opt1 from anti-HIV_CDR
  source 1..33: mol_type = other RNA
gccgcctacgacagcaccttctccctgcccgtg

SEQ ID NO: 13671 - RNA, 33 nt, synthetic construct
  misc_feature 1..33: note = derived and/or modified sequence opt1 from anti-HIV_CDR
  source 1..33: mol_type = other RNA
gccacctacgacagccagggctccacccgcctg

SEQ ID NO: 13672 - RNA, 33 nt, synthetic construct
  misc_feature 1..33: note = derived and/or modified sequence opt1 from anti-HIV_CDR
  source 1..33: mol_type = other RNA
gccacctacgacagccagcgctccatccggctg

SEQ ID NO: 13673 - RNA, 33 nt, synthetic construct
  misc_feature 1..33: note = derived and/or modified sequence opt1 from anti-HIV_CDR
  source 1..33: mol_type = other RNA
gccgtgtacgacagctccctgagcctcggcctg

SEQ ID NO: 13674 - RNA, 33 nt, synthetic construct
  misc_feature 1..33: note = derived and/or modified sequence opt1 from anti-HIV_CDR
  source 1..33: mol_type = other RNA
cagcaccgcagcatctggcccctgatgtgcacc

SEQ ID NO: 13675 - RNA, 33 nt, synthetic construct
  misc_feature 1..33: note = derived and/or modified sequence opt1 from anti-HIV_CDR
  source 1..33: mol_type = other RNA
ctgcagcccgtgtacatcttccgcggcacctgg

SEQ ID NO: 13676 - RNA, 33 nt, synthetic construct
  misc_feature 1..33: note = derived and/or modified sequence opt1 from anti-HIV_CDR
  source 1..33: mol_type = other RNA
tgcgaggtcgacgccgacgagaccgtgacctgc

SEQ ID NO: 13677 - RNA, 33 nt, synthetic construct
  misc_feature 1..33: note = derived and/or modified sequence opt1 from anti-HIV_CDR
  source 1..33: mol_type = other RNA
tgcgaggtggacgccgaggtcaccatgaccgtg

SEQ ID NO: 13678 - RNA, 33 nt, synthetic construct
  misc_feature 1..33: note = derived and/or modified sequence opt1 from anti-HIV_CDR
  source 1..33: mol_type = other RNA
agctcctacgccgacaccaacgacttcggcgtg

SEQ ID NO: 13679 - RNA, 33 nt, synthetic construct
  misc_feature 1..33: note = derived and/or modified sequence opt1 from anti-HIV_CDR
  source 1..33: mol_type = other RNA
tgcagcttcacctacgtgaaccccacctacctg

SEQ ID NO: 13680 - RNA, 33 nt, synthetic construct
  misc_feature 1..33: note = derived and/or modified sequence opt1 from anti-HIV_CDR
  source 1..33: mol_type = other RNA
ggcacctgggacgggagcctgaccacgggcgtg

SEQ ID NO: 13681 - RNA, 33 nt, synthetic construct
  misc_feature 1..33: note = derived and/or modified sequence opt1 from anti-HIV_CDR
  source 1..33: mol_type = other RNA
cagagctacgacaactccctgagcggctgggtg

SEQ ID NO: 13682 - RNA, 33 nt, synthetic construct
  misc_feature 1..33: note = derived and/or modified sequence opt1 from anti-HIV_CDR
  source 1..33: mol_type = other RNA
cagcagtactacagcatcccgccctggaccttc

SEQ ID NO: 13683 - RNA, 33 nt, synthetic construct
  misc_feature 1..33: note = derived and/or modified sequence opt1 from anti-HIV_CDR
  source 1..33: mol_type = other RNA
atgcagggcacctactggcccccgagcatcacc

SEQ ID NO: 13684 - RNA, 33 nt, synthetic construct
  misc_feature 1..33: note = derived and/or modified sequence opt1 from anti-HIV_CDR
  source 1..33: mol_type = other RNA
cagagctacgactccagcctgggcgtggaggtc

SEQ ID NO: 13685 - RNA, 33 nt, synthetic construct
  misc_feature 1..33: note = derived and/or modified sequence opt1 from anti-HIV_CDR
  source 1..33: mol_type = other RNA
caggtgtgggacagcggccgcgactcctgggtc

SEQ ID NO: 13686 - RNA, 33 nt, synthetic construct
  misc_feature 1..33: note = derived and/or modified sequence opt1 from anti-HIV_CDR
  source 1..33: mol_type = other RNA
cagagctacgactccagcctgtccggctgggtg

SEQ ID NO: 13687 - RNA, 33 nt, synthetic construct
  misc_feature 1..33: note = derived and/or modified sequence opt1 from anti-HIV_CDR
  source 1..33: mol_type = other RNA
ggcagctgggacgggtccctgaacgccggcgtg

SEQ ID NO: 13688 - RNA, 33 nt, synthetic construct
  misc_feature 1..33: note = derived and/or modified sequence opt1 from anti-HIV_CDR
  source 1..33: mol_type = other RNA
ctgagcgccgactccagctccacctaccaggtg

SEQ ID NO: 13689 - RNA, 33 nt, synthetic construct
  misc_feature 1..33: note = derived and/or modified sequence opt1 from anti-HIV_CDR
  source 1..33: mol_type = other RNA
tgcagctacgccggccgcgacacctcctgggtg

SEQ ID NO: 13690 - RNA, 33 nt, synthetic construct
  misc_feature 1..33: note = derived and/or modified sequence opt1 from anti-HIV_CDR
  source 1..33: mol_type = other RNA
cagcagcgcagcaactggcccccgggcctgacc

SEQ ID NO: 13691 - RNA, 33 nt, synthetic construct
  misc_feature 1..33: note = derived and/or modified sequence opt1 from anti-HIV_CDR
  source 1..33: mol_type = other RNA
aagggccgcgggtacggctactggttcgacagc

SEQ ID NO: 13692 - RNA, 33 nt, synthetic construct
  misc_feature 1..33: note = derived and/or modified sequence opt1 from anti-HIV_CDR
  source 1..33: mol_type = other RNA
gagatggccgccaccagcgacgcgttcgacatc

SEQ ID NO: 13693 - RNA, 33 nt, synthetic construct
  misc_feature 1..33: note = derived and/or modified sequence opt1 from anti-HIV_CDR
  source 1..33: mol_type = other RNA
agcatctactccaccggccccgccccggtgtac

SEQ ID NO: 13694 - RNA, 33 nt, synthetic construct
  misc_feature 1..33: note = derived and/or modified sequence opt1 from anti-HIV_CDR
  source 1..33: mol_type = other RNA
cgcggcagcctgctcatcaagtacttcgactac

SEQ ID NO: 13695 - RNA, 33 nt, synthetic construct
  misc_feature 1..33: note = derived and/or modified sequence opt1 from anti-HIV_CDR
  source 1..33: mol_type = other RNA
cagcagtacgacaacctgcccccgcgcgtgacc

SEQ ID NO: 13696 - RNA, 33 nt, synthetic construct
  misc_feature 1..33: note = derived and/or modified sequence opt1 from anti-HIV_CDR
  source 1..33: mol_type = other RNA
gacgtgcgcctggtcgccgtgcccggcgccgac

SEQ ID NO: 13697 - RNA, 33 nt, synthetic construct
  misc_feature 1..33: note = derived and/or modified sequence opt1 from anti-HIV_CDR
  source 1..33: mol_type = other RNA
cagcagcgcaccacctggcccccggagtacacg

SEQ ID NO: 13698 - RNA, 33 nt, synthetic construct
  misc_feature 1..33: note = derived and/or modified sequence opt1 from anti-HIV_CDR
  source 1..33: mol_type = other RNA
gccgcctgggacgacagcctgaacggctgggtg

SEQ ID NO: 13699 - RNA, 33 nt, synthetic construct
  misc_feature 1..33: note = derived and/or modified sequence opt1 from anti-HIV_CDR
  source 1..33: mol_type = other RNA
cgccggcgcagcgcctggtcccccttcgacagc

SEQ ID NO: 13700 - RNA, 33 nt, synthetic construct
  misc_feature 1..33: note = derived and/or modified sequence opt1 from anti-HIV_CDR
  source 1..33: mol_type = other RNA
gccacctgggacagctccctgcgcaccgccctc

SEQ ID NO: 13701 - RNA, 33 nt, synthetic construct
  misc_feature 1..33: note = derived and/or modified sequence opt1 from anti-HIV_CDR
  source 1..33: mol_type = other RNA
ggcacctgggacagctccctgcgcgccgccctc

SEQ ID NO: 13702 - RNA, 33 nt, synthetic construct
  misc_feature 1..33: note = derived and/or modified sequence opt1 from anti-HIV_CDR
  source 1..33: mol_type = other RNA
cagcagcgcagcatctggcccccgtccctgacc

SEQ ID NO: 13703 - RNA, 33 nt, synthetic construct
  misc_feature 1..33: note = derived and/or modified sequence opt1 from anti-HIV_CDR
  source 1..33: mol_type = other RNA
gagttccagaccagcggcgtggtccgcgagggg

SEQ ID NO: 13704 - RNA, 33 nt, synthetic construct
  misc_feature 1..33: note = derived and/or modified sequence opt1 from anti-HIV_CDR
  source 1..33: mol_type = other RNA
cacatcggcgccgggggcccctacagcgagtac

SEQ ID NO: 13705 - RNA, 33 nt, synthetic construct
  misc_feature 1..33: note = derived and/or modified sequence opt1 from anti-HIV_CDR
  source 1..33: mol_type = other RNA
cgcggccacagcttcacctcccccttcgacagc

SEQ ID NO: 13706 - RNA, 33 nt, synthetic construct
  misc_feature 1..33: note = derived and/or modified sequence opt1 from anti-HIV_CDR
  source 1..33: mol_type = other RNA
cagcacctgaacagctacccccgcatgtacacc

SEQ ID NO: 13707 - RNA, 33 nt, synthetic construct
  misc_feature 1..33: note = derived and/or modified sequence opt1 from anti-HIV_CDR
  source 1..33: mol_type = other RNA
cagcagcgcagcaactggcccccgaagatcacc

SEQ ID NO: 13708 - RNA, 33 nt, synthetic construct
  misc_feature 1..33: note = derived and/or modified sequence opt1 from anti-HIV_CDR
  source 1..33: mol_type = other RNA
gccgcctgggacgacagcctgggcggggtggtc

SEQ ID NO: 13709 - RNA, 33 nt, synthetic construct
  misc_feature 1..33: note = derived and/or modified sequence opt1 from anti-HIV_CDR
  source 1..33: mol_type = other RNA
ggcacctgggacagctccctgagcgccgtggtc

SEQ ID NO: 13710 - RNA, 33 nt, synthetic construct
  misc_feature 1..33: note = derived and/or modified sequence opt1 from anti-HIV_CDR
  source 1..33: mol_type = other RNA
cagcagcgcgccaactggcccccgggcgggacc

SEQ ID NO: 13711 - RNA, 33 nt, synthetic construct
  misc_feature 1..33: note = derived and/or modified sequence opt1 from anti-HIV_CDR
  source 1..33: mol_type = other RNA
ggcgggggctacccccgcgggaacatggacgtg

SEQ ID NO: 13712 - RNA, 33 nt, synthetic construct
  misc_feature 1..33: note = derived and/or modified sequence opt1 from anti-HIV_CDR
  source 1..33: mol_type = other RNA
ctgctcctgctgtactacggcgggccctggatc

SEQ ID NO: 13713 - RNA, 33 nt, synthetic construct
  misc_feature 1..33: note = derived and/or modified sequence opt1 from anti-HIV_CDR
  source 1..33: mol_type = other RNA
cagcagcgcggcatctggcccctgcagatcacc

SEQ ID NO: 13714 - RNA, 33 nt, synthetic construct
  misc_feature 1..33: note = derived and/or modified sequence opt1 from anti-HIV_CDR
  source 1..33: mol_type = other RNA
cgcagccccggcgggggctacgccttcgacatc

SEQ ID NO: 13715 - RNA, 33 nt, synthetic construct
  misc_feature 1..33: note = derived and/or modified sequence opt1 from anti-HIV_CDR
  source 1..33: mol_type = other RNA
agcggccccgggctgctccgcggcttcgactac

SEQ ID NO: 13716 - RNA, 33 nt, synthetic construct
  misc_feature 1..33: note = derived and/or modified sequence opt1 from anti-HIV_CDR
  source 1..33: mol_type = other RNA
cagcagcgcaccacccggcccccggagtacacg

SEQ ID NO: 13717 - RNA, 33 nt, synthetic construct
  misc_feature 1..33: note = derived and/or modified sequence opt1 from anti-HIV_CDR
  source 1..33: mol_type = other RNA
cagcagcgcaccacccggcccccggactacacg

SEQ ID NO: 13718 - RNA, 33 nt, synthetic construct
  misc_feature 1..33: note = derived and/or modified sequence opt1 from anti-HIV_CDR
  source 1..33: mol_type = other RNA
cagggccgcaccacccggcccccggactacacg

SEQ ID NO: 13719 - RNA, 33 nt, synthetic construct
  misc_feature 1..33: note = derived and/or modified sequence opt1 from anti-HIV_CDR
  source 1..33: mol_type = other RNA
cagcagcgcagcaccacgcccccggagtacacc

SEQ ID NO: 13720 - RNA, 33 nt, synthetic construct
  misc_feature 1..33: note = derived and/or modified sequence opt1 from anti-HIV_CDR
  source 1..33: mol_type = other RNA
cagcagcgcaccagctggcccctggccctctcc

SEQ ID NO: 13721 - RNA, 33 nt, synthetic construct
  misc_feature 1..33: note = derived and/or modified sequence opt1 from anti-HIV_CDR
  source 1..33: mol_type = other RNA
cgcggccacagcttctccctgcccttcgacagc

SEQ ID NO: 13722 - RNA, 36 nt, synthetic construct
  misc_feature 1..36: note = derived and/or modified sequence opt1 from anti-HIV_CDR
  source 1..36: mol_type = other RNA
cactactgggacagccgctcccccatcagctgggtg

SEQ ID NO: 13723 - RNA, 36 nt, synthetic construct
  misc_feature 1..36: note = derived and/or modified sequence opt1 from anti-HIV_CDR
  source 1..36: mol_type = other RNA
cacaagtgggacagccgcagccccctgtcctgggtg

SEQ ID NO: 13724 - RNA, 36 nt, synthetic construct
  misc_feature 1..36: note = derived and/or modified sequence opt1 from anti-HIV_CDR
  source 1..36: mol_type = other RNA
cacatgtgggacagccgctccggcttcagctggtcc

SEQ ID NO: 13725 - RNA, 36 nt, synthetic construct
  misc_feature 1..36: note = derived and/or modified sequence opt1 from anti-HIV_CDR
  source 1..36: mol_type = other RNA
cacatctgggacagccgcgtgcccaccaagtgggtc

SEQ ID NO: 13726 - RNA, 36 nt, synthetic construct
  misc_feature 1..36: note = derived and/or modified sequence opt1 from anti-HIV_CDR
  source 1..36: mol_type = other RNA
caggtgtgggacagctccagcgaccacccctgggtc

SEQ ID NO: 13727 - RNA, 36 nt, synthetic construct
  misc_feature 1..36: note = derived and/or modified sequence opt1 from anti-HIV_CDR
  source 1..36: mol_type = other RNA
cacatctacgacgcccgccggcccaccaactgggtg

SEQ ID NO: 13728 - RNA, 36 nt, synthetic construct
  misc_feature 1..36: note = derived and/or modified sequence opt1 from anti-HIV_CDR
  source 1..36: mol_type = other RNA
ctggacggcgaggccttccgctactacctcgacctg

SEQ ID NO: 13729 - RNA, 36 nt, synthetic construct
  misc_feature 1..36: note = derived and/or modified sequence opt1 from anti-HIV_CDR
  source 1..36: mol_type = other RNA
ccccagtacaacctgggccgcgacccgctcgacgtg

SEQ ID NO: 13730 - RNA, 36 nt, synthetic construct
  misc_feature 1..36: note = derived and/or modified sequence opt1 from anti-HIV_CDR
  source 1..36: mol_type = other RNA
cccgagcccagctccatcgtggccccgctgtactac

SEQ ID NO: 13731 - RNA, 36 nt, synthetic construct
  misc_feature 1..36: note = derived and/or modified sequence opt1 from anti-HIV_CDR
  source 1..36: mol_type = other RNA
ggcgggggcgacgggcgcaactggcacctgcacccc

SEQ ID NO: 13732 - RNA, 36 nt, synthetic construct
  misc_feature 1..36: note = derived and/or modified sequence opt1 from anti-HIV_CDR
  source 1..36: mol_type = other RNA
cccaagagcggccgcgactactggtccttcgacctg

SEQ ID NO: 13733 - RNA, 36 nt, synthetic construct
  misc_feature 1..36: note = derived and/or modified sequence opt1 from anti-HIV_CDR
  source 1..36: mol_type = other RNA
ccccgcggcgggcgggacaactggagcttccacgtg

SEQ ID NO: 13734 - RNA, 36 nt, synthetic construct
  misc_feature 1..36: note = derived and/or modified sequence opt1 from anti-HIV_CDR
  source 1..36: mol_type = other RNA
ccccacagcccggacgacgcctggtccctggacgtg

SEQ ID NO: 13735 - RNA, 36 nt, synthetic construct
  misc_feature 1..36: note = derived and/or modified sequence opt1 from anti-HIV_CDR
  source 1..36: mol_type = other RNA
cccctgcgcggcggggacacctggcactaccacagc

SEQ ID NO: 13736 - RNA, 36 nt, synthetic construct
  misc_feature 1..36: note = derived and/or modified sequence opt1 from anti-HIV_CDR
  source 1..36: mol_type = other RNA
ctgcagcccgtgtacatcctccgcagcatctgccac

SEQ ID NO: 13737 - RNA, 36 nt, synthetic construct
  misc_feature 1..36: note = derived and/or modified sequence opt1 from anti-HIV_CDR
  source 1..36: mol_type = other RNA
ctgcagcccgtgtacatcctcaagtgcaactggtgc

SEQ ID NO: 13738 - RNA, 36 nt, synthetic construct
  misc_feature 1..36: note = derived and/or modified sequence opt1 from anti-HIV_CDR
  source 1..36: mol_type = other RNA
gagtaccgcttcgacgactggggccccctggaccac

SEQ ID NO: 13739 - RNA, 36 nt, synthetic construct
  misc_feature 1..36: note = derived and/or modified sequence opt1 from anti-HIV_CDR
  source 1..36: mol_type = other RNA
gccgcctgggacgacagcctgaacggccacggggtg

SEQ ID NO: 13740 - RNA, 36 nt, synthetic construct
  misc_feature 1..36: note = derived and/or modified sequence opt1 from anti-HIV_CDR
  source 1..36: mol_type = other RNA
ctgtacttcgactgggccccccacgccttcgacatc

SEQ ID NO: 13741 - RNA, 36 nt, synthetic construct
  misc_feature 1..36: note = derived and/or modified sequence opt1 from anti-HIV_CDR
  source 1..36: mol_type = other RNA
ggcctgtacgacagctccgggtactacttcggctac

SEQ ID NO: 13742 - RNA, 36 nt, synthetic construct
  misc_feature 1..36: note = derived and/or modified sequence opt1 from anti-HIV_CDR
  source 1..36: mol_type = other RNA
ctgggctgcagcgggggctcctgctacgaggacagc

SEQ ID NO: 13743 - RNA, 36 nt, synthetic construct
  misc_feature 1..36: note = derived and/or modified sequence opt1 from anti-HIV_CDR
  source 1..36: mol_type = other RNA
gccagcggctcctacatcctggggaccatggacgtg

SEQ ID NO: 13744 - RNA, 36 nt, synthetic construct
  misc_feature 1..36: note = derived and/or modified sequence opt1 from anti-HIV_CDR
  source 1..36: mol_type = other RNA
tacagcaccgacaactccggcaagcagcactgggtg

SEQ ID NO: 13745 - RNA, 36 nt, synthetic construct
  misc_feature 1..36: note = derived and/or modified sequence opt1 from anti-HIV_CDR
  source 1..36: mol_type = other RNA
gtgaagcagttcctggagtggctctacctggactac

SEQ ID NO: 13746 - RNA, 36 nt, synthetic construct
  misc_feature 1..36: note = derived and/or modified sequence opt1 from anti-HIV_CDR
  source 1..36: mol_type = other RNA
ggcgtgcgcagcatcgtcggggcccacttcgactac

SEQ ID NO: 13747 - RNA, 36 nt, synthetic construct
  misc_feature 1..36: note = derived and/or modified sequence opt1 from anti-HIV_CDR
  source 1..36: mol_type = other RNA
ggcgtggggacccgctactacgtctacttcgacagc

SEQ ID NO: 13748 - RNA, 36 nt, synthetic construct
  misc_feature 1..36: note = derived and/or modified sequence opt1 from anti-HIV_CDR
  source 1..36: mol_type = other RNA
gccccctacatcagctccagccacctggactactgg

SEQ ID NO: 13749 - RNA, 36 nt, synthetic construct
  misc_feature 1..36: note = derived and/or modified sequence opt1 from anti-HIV_CDR
  source 1..36: mol_type = other RNA
cgcggcatcgccgccgcggggttctacttccagcac

SEQ ID NO: 13750 - RNA, 36 nt, synthetic construct
  misc_feature 1..36: note = derived and/or modified sequence opt1 from anti-HIV_CDR
  source 1..36: mol_type = other RNA
cgcggcatcgccgccgcggccttctacttccagacc

SEQ ID NO: 13751 - RNA, 36 nt, synthetic construct
  misc_feature 1..36: note = derived and/or modified sequence opt1 from anti-HIV_CDR
  source 1..36: mol_type = other RNA
cgcggcatcgccgccgcggggttctacttccagaac

SEQ ID NO: 13752 - RNA, 36 nt, synthetic construct
  misc_feature 1..36: note = derived and/or modified sequence opt1 from anti-HIV_CDR
  source 1..36: mol_type = other RNA
cagagctacgacacctccctgaccgacacgggcgtg

SEQ ID NO: 13753 - RNA, 36 nt, synthetic construct
  misc_feature 1..36: note = derived and/or modified sequence opt1 from anti-HIV_CDR
  source 1..36: mol_type = other RNA
cagagctacgacacctccctgagcgacaccggcgtg

SEQ ID NO: 13754 - RNA, 36 nt, synthetic construct
  misc_feature 1..36: note = derived and/or modified sequence opt1 from anti-HIV_CDR
  source 1..36: mol_type = other RNA
cgcaccaccctggtgaacttcggcgtcttcgacctc

SEQ ID NO: 13755 - RNA, 36 nt, synthetic construct
  misc_feature 1..36: note = derived and/or modified sequence opt1 from anti-HIV_CDR
  source 1..36: mol_type = other RNA
cccgtggtcaacaccatcctgccgtactgcgacgtg

SEQ ID NO: 13756 - RNA, 36 nt, synthetic construct
  misc_feature 1..36: note = derived and/or modified sequence opt1 from anti-HIV_CDR
  source 1..36: mol_type = other RNA
tgctacagcggccgctcccggtacttcttcgacagc

SEQ ID NO: 13757 - RNA, 36 nt, synthetic construct
  misc_feature 1..36: note = derived and/or modified sequence opt1 from anti-HIV_CDR
  source 1..36: mol_type = other RNA
gccgcctgggacgacagcctggacggcttctgggtg

SEQ ID NO: 13758 - RNA, 36 nt, synthetic construct
  misc_feature 1..36: note = derived and/or modified sequence opt1 from anti-HIV_CDR
  source 1..36: mol_type = other RNA
ctgcgccggggctactacgacagcggggaggactac

SEQ ID NO: 13759 - RNA, 36 nt, synthetic construct
  misc_feature 1..36: note = derived and/or modified sequence opt1 from anti-HIV_CDR
  source 1..36: mol_type = other RNA
ctgcgccggggctacttcgacagcgggggcgaccac

SEQ ID NO: 13760 - RNA, 36 nt, synthetic construct
  misc_feature 1..36: note = derived and/or modified sequence opt1 from anti-HIV_CDR
  source 1..36: mol_type = other RNA
agctcctacaccagctccagcaccctgggcgtggtc

SEQ ID NO: 13761 - RNA, 36 nt, synthetic construct
  misc_feature 1..36: note = derived and/or modified sequence opt1 from anti-HIV_CDR
  source 1..36: mol_type = other RNA
ctggacggcgaggccttccgctactacttcgacagc

SEQ ID NO: 13762 - RNA, 36 nt, synthetic construct
  misc_feature 1..36: note = derived and/or modified sequence opt1 from anti-HIV_CDR
  source 1..36: mol_type = other RNA
cgccggggccagcgcctgctcgcctacttcgactac

SEQ ID NO: 13763 - RNA, 36 nt, synthetic construct
  misc_feature 1..36: note = derived and/or modified sequence opt1 from anti-HIV_CDR
  source 1..36: mol_type = other RNA
ccccagtacaacctgggccgcgagccgctcaacgtg

SEQ ID NO: 13764 - RNA, 36 nt, synthetic construct
  misc_feature 1..36: note = derived and/or modified sequence opt1 from anti-HIV_CDR
  source 1..36: mol_type = other RNA
gcccaccacgacttctggcgcgcccccgtggacgtc

SEQ ID NO: 13765 - RNA, 36 nt, synthetic construct
  misc_feature 1..36: note = derived and/or modified sequence opt1 from anti-HIV_CDR
  source 1..36: mol_type = other RNA
ggccgccgggaggggctgaacttcctcctggactac

SEQ ID NO: 13766 - RNA, 36 nt, synthetic construct
  misc_feature 1..36: note = derived and/or modified sequence opt1 from anti-HIV_CDR
  source 1..36: mol_type = other RNA
cccgagccgagctccatcgtgggcgccctgtactac

SEQ ID NO: 13767 - RNA, 36 nt, synthetic construct
  misc_feature 1..36: note = derived and/or modified sequence opt1 from anti-HIV_CDR
  source 1..36: mol_type = other RNA
ggccccgacgacttctggagcgggtacccgaagtac

SEQ ID NO: 13768 - RNA, 36 nt, synthetic construct
  misc_feature 1..36: note = derived and/or modified sequence opt1 from anti-HIV_CDR
  source 1..36: mol_type = other RNA
gactacagcgccgccggccgccacctgttcgactcc

SEQ ID NO: 13769 - RNA, 36 nt, synthetic construct
  misc_feature 1..36: note = derived and/or modified sequence opt1 from anti-HIV_CDR
  source 1..36: mol_type = other RNA
gactacaccgcccgcggccggcacttcttcgactac

SEQ ID NO: 13770 - RNA, 36 nt, synthetic construct
  misc_feature 1..36: note = derived and/or modified sequence opt1 from anti-HIV_CDR
  source 1..36: mol_type = other RNA
gactacaccgccagcggccgccacttcttcgactac

SEQ ID NO: 13771 - RNA, 36 nt, synthetic construct
  misc_feature 1..36: note = derived and/or modified sequence opt1 from anti-HIV_CDR
  source 1..36: mol_type = other RNA
cagagctacgactccagcctgtccggcagctgggtg

SEQ ID NO: 13772 - RNA, 36 nt, synthetic construct
  misc_feature 1..36: note = derived and/or modified sequence opt1 from anti-HIV_CDR
  source 1..36: mol_type = other RNA
cccgcccaggccggcgtggggccgcgcttcgactac

SEQ ID NO: 13773 - RNA, 36 nt, synthetic construct
  misc_feature 1..36: note = derived and/or modified sequence opt1 from anti-HIV_CDR
  source 1..36: mol_type = other RNA
ggcgccatcaacagcagccccctgtacttcgactcc

SEQ ID NO: 13774 - RNA, 36 nt, synthetic construct
  misc_feature 1..36: note = derived and/or modified sequence opt1 from anti-HIV_CDR
  source 1..36: mol_type = other RNA
ggcgacatcacctccagccccctgtacttcgacttc

SEQ ID NO: 13775 - RNA, 36 nt, synthetic construct
  misc_feature 1..36: note = derived and/or modified sequence opt1 from anti-HIV_CDR
  source 1..36: mol_type = other RNA
ggcgccatcaacagctcccccagctacttcgactcc

SEQ ID NO: 13776 - RNA, 36 nt, synthetic construct
  misc_feature 1..36: note = derived and/or modified sequence opt1 from anti-HIV_CDR
  source 1..36: mol_type = other RNA
tgggtggtcaccgccgccgaggagtacttcgactac

SEQ ID NO: 13777 - RNA, 39 nt, synthetic construct
  misc_feature 1..39: note = derived and/or modified sequence opt1 from anti-HIV_CDR
  source 1..39: mol_type = other RNA
gacccccaggtggaggtccgcggcaacgccttcgacatc

SEQ ID NO: 13778 - RNA, 39 nt, synthetic construct
  misc_feature 1..39: note = derived and/or modified sequence opt1 from anti-HIV_CDR
  source 1..39: mol_type = other RNA
gaccacggcgacccccgcaccgggtactacttcgactac

SEQ ID NO: 13779 - RNA, 39 nt, synthetic construct
  misc_feature 1..39: note = derived and/or modified sequence opt1 from anti-HIV_CDR
  source 1..39: mol_type = other RNA
gacgagagcggctacgacctgaactggcacctcgactcc

SEQ ID NO: 13780 - RNA, 39 nt, synthetic construct
  misc_feature 1..39: note = derived and/or modified sequence opt1 from anti-HIV_CDR
  source 1..39: mol_type = other RNA
gacggcagcggggacgaccgcaactggcacctggacccc

SEQ ID NO: 13781 - RNA, 39 nt, synthetic construct
  misc_feature 1..39: note = derived and/or modified sequence opt1 from anti-HIV_CDR
  source 1..39: mol_type = other RNA
gaccgccgggacgacggcctggactggctcctggacccc

SEQ ID NO: 13782 - RNA, 39 nt, synthetic construct
  misc_feature 1..39: note = derived and/or modified sequence opt1 from anti-HIV_CDR
  source 1..39: mol_type = other RNA
gacggcgggggcgacgaccgcacctggctgctcgacgcc

SEQ ID NO: 13783 - RNA, 39 nt, synthetic construct
  misc_feature 1..39: note = derived and/or modified sequence opt1 from anti-HIV_CDR
  source 1..39: mol_type = other RNA
gacggcagcggggacgcccgcgactggcacctgcacccc

SEQ ID NO: 13784 - RNA, 39 nt, synthetic construct
  misc_feature 1..39: note = derived and/or modified sequence opt1 from anti-HIV_CDR
  source 1..39: mol_type = other RNA
gacggcagcggggacgacacctcctggtacctggacccc

SEQ ID NO: 13785 - RNA, 39 nt, synthetic construct
  misc_feature 1..39: note = derived and/or modified sequence opt1 from anti-HIV_CDR
  source 1..39: mol_type = other RNA
gacggcagcggggacgacacctcctggcacctggacccc

SEQ ID NO: 13786 - RNA, 39 nt, synthetic construct
  misc_feature 1..39: note = derived and/or modified sequence opt1 from anti-HIV_CDR
  source 1..39: mol_type = other RNA
gaccgccgggacgacgaccgcgcctggctgctcgacccc

SEQ ID NO: 13787 - RNA, 39 nt, synthetic construct
  misc_feature 1..39: note = derived and/or modified sequence opt1 from anti-HIV_CDR
  source 1..39: mol_type = other RNA
gacggcagcggggacgcccgcgactggcacctggacccc

SEQ ID NO: 13788 - RNA, 39 nt, synthetic construct
  misc_feature 1..39: note = derived and/or modified sequence opt1 from anti-HIV_CDR
  source 1..39: mol_type = other RNA
gacggcagcggggacgccacctcctggcacctgcacccc

SEQ ID NO: 13789 - RNA, 39 nt, synthetic construct
  misc_feature 1..39: note = derived and/or modified sequence opt1 from anti-HIV_CDR
  source 1..39: mol_type = other RNA
gacgagagcggcgacgacctgaagtggcacctccacccc

SEQ ID NO: 13790 - RNA, 39 nt, synthetic construct
  misc_feature 1..39: note = derived and/or modified sequence opt1 from anti-HIV_CDR
  source 1..39: mol_type = other RNA
gacggcagcggggacgacacctcctggcacctgcacccc

SEQ ID NO: 13791 - RNA, 39 nt, synthetic construct
  misc_feature 1..39: note = derived and/or modified sequence opt1 from anti-HIV_CDR
  source 1..39: mol_type = other RNA
gcccagggcgacatcctgaccgaggggtacttcgactac

SEQ ID NO: 13792 - RNA, 39 nt, synthetic construct
  misc_feature 1..39: note = derived and/or modified sequence opt1 from anti-HIV_CDR
  source 1..39: mol_type = other RNA
gaccgcatgttctggcagcagctggccaagtacgacagc

SEQ ID NO: 13793 - RNA, 39 nt, synthetic construct
  misc_feature 1..39: note = derived and/or modified sequence opt1 from anti-HIV_CDR
  source 1..39: mol_type = other RNA
agcacctgggactactccctgagcgcccacgaggacgtg

SEQ ID NO: 13794 - RNA, 39 nt, synthetic construct
  misc_feature 1..39: note = derived and/or modified sequence opt1 from anti-HIV_CDR
  source 1..39: mol_type = other RNA
gccgcctgggacgacagcctgtccggcctcaactgggtg

SEQ ID NO: 13795 - RNA, 39 nt, synthetic construct
  misc_feature 1..39: note = derived and/or modified sequence opt1 from anti-HIV_CDR
  source 1..39: mol_type = other RNA
ctgagctccgaccgcatcgtggtcgtgggccccgactac

SEQ ID NO: 13796 - RNA, 39 nt, synthetic construct
  misc_feature 1..39: note = derived and/or modified sequence opt1 from anti-HIV_CDR
  source 1..39: mol_type = other RNA
gaggccggcagcgtgaccgccaccgggcccttcgactcc

SEQ ID NO: 13797 - RNA, 39 nt, synthetic construct
  misc_feature 1..39: note = derived and/or modified sequence opt1 from anti-HIV_CDR
  source 1..39: mol_type = other RNA
gacttcggccgcgcctacgccatcgggtacttcgagtac

SEQ ID NO: 13798 - RNA, 39 nt, synthetic construct
  misc_feature 1..39: note = derived and/or modified sequence opt1 from anti-HIV_CDR
  source 1..39: mol_type = other RNA
gaccgcgccccctacggcgccttcgagccgttcgacttc

SEQ ID NO: 13799 - RNA, 39 nt, synthetic construct
  misc_feature 1..39: note = derived and/or modified sequence opt1 from anti-HIV_CDR
  source 1..39: mol_type = other RNA
aacgggcacagctccctgggcggcgggtacttcccccac

SEQ ID NO: 13800 - RNA, 39 nt, synthetic construct
  misc_feature 1..39: note = derived and/or modified sequence opt1 from anti-HIV_CDR
  source 1..39: mol_type = other RNA
aacggccacagcgccctgggcggggagtacttccagcac

SEQ ID NO: 13801 - RNA, 39 nt, synthetic construct
  misc_feature 1..39: note = derived and/or modified sequence opt1 from anti-HIV_CDR
  source 1..39: mol_type = other RNA
gccgcccgccgggcgttctactactactacatggacgtg

SEQ ID NO: 13802 - RNA, 39 nt, synthetic construct
  misc_feature 1..39: note = derived and/or modified sequence opt1 from anti-HIV_CDR
  source 1..39: mol_type = other RNA
gccaactactacgacagctccggctacgggctggacatc

SEQ ID NO: 13803 - RNA, 39 nt, synthetic construct
  misc_feature 1..39: note = derived and/or modified sequence opt1 from anti-HIV_CDR
  source 1..39: mol_type = other RNA
cacagccgccccggcgccccgccccactacttcgactac

SEQ ID NO: 13804 - RNA, 39 nt, synthetic construct
  misc_feature 1..39: note = derived and/or modified sequence opt1 from anti-HIV_CDR
  source 1..39: mol_type = other RNA
ggcctgaccgtggccaccctctacgacgccttcgacgtc

SEQ ID NO: 13805 - RNA, 39 nt, synthetic construct
  misc_feature 1..39: note = derived and/or modified sequence opt1 from anti-HIV_CDR
  source 1..39: mol_type = other RNA
cgcgaccggtacaactggaagtactactacctggacgtg

SEQ ID NO: 13806 - RNA, 39 nt, synthetic construct
  misc_feature 1..39: note = derived and/or modified sequence opt1 from anti-HIV_CDR
  source 1..39: mol_type = other RNA
gaccgcggcagctccgggtggtacggctggctggacccc

SEQ ID NO: 13807 - RNA, 39 nt, synthetic construct
  misc_feature 1..39: note = derived and/or modified sequence opt1 from anti-HIV_CDR
  source 1..39: mol_type = other RNA
gaccgcctgagctccttctggagcggcgggatcgaccag

SEQ ID NO: 13808 - RNA, 39 nt, synthetic construct
  misc_feature 1..39: note = derived and/or modified sequence opt1 from anti-HIV_CDR
  source 1..39: mol_type = other RNA
gacgtgatcgtcggcgccctgctcggggccttcgacatc

SEQ ID NO: 13809 - RNA, 39 nt, synthetic construct
  misc_feature 1..39: note = derived and/or modified sequence opt1 from anti-HIV_CDR
  source 1..39: mol_type = other RNA
cacctgatcgcccccaccgccggcaactacttctacccg

SEQ ID NO: 13810 - RNA, 39 nt, synthetic construct
  misc_feature 1..39: note = derived and/or modified sequence opt1 from anti-HIV_CDR
  source 1..39: mol_type = other RNA
gacagccgcccccaggccctggtggccgcgctcgacgtc

SEQ ID NO: 13811 - RNA, 39 nt, synthetic construct
  misc_feature 1..39: note = derived and/or modified sequence opt1 from anti-HIV_CDR
  source 1..39: mol_type = other RNA
gacgagatcgtgggcgccctgctcggggccttcgacatc

SEQ ID NO: 13812 - RNA, 39 nt, synthetic construct
  misc_feature 1..39: note = derived and/or modified sequence opt1 from anti-HIV_CDR
  source 1..39: mol_type = other RNA
agcgaccccgccatcgccgcggccggctccctggacctc

SEQ ID NO: 13813 - RNA, 39 nt, synthetic construct
  misc_feature 1..39: note = derived and/or modified sequence opt1 from anti-HIV_CDR
  source 1..39: mol_type = other RNA
ccctacgtgcagaccgtcgccaccacgaccttcgacttc

SEQ ID NO: 13814 - RNA, 39 nt, synthetic construct
  misc_feature 1..39: note = derived and/or modified sequence opt1 from anti-HIV_CDR
  source 1..39: mol_type = other RNA
ggccccaagagcgtggcctccctgagctacttcgacaag

SEQ ID NO: 13815 - RNA, 39 nt, synthetic construct
  misc_feature 1..39: note = derived and/or modified sequence opt1 from anti-HIV_CDR
  source 1..39: mol_type = other RNA
ggcgccctgtggttcgggcagctccgcggcctggacccc

SEQ ID NO: 13816 - RNA, 39 nt, synthetic construct
  misc_feature 1..39: note = derived and/or modified sequence opt1 from anti-HIV_CDR
  source 1..39: mol_type = other RNA
gacctgcgccccatgcggggcaactgggccatgcacgtg

SEQ ID NO: 13817 - RNA, 39 nt, synthetic construct
  misc_feature 1..39: note = derived and/or modified sequence opt1 from anti-HIV_CDR
  source 1..39: mol_type = other RNA
gacccccaggtgaaccgccggggcaactgcttcgaccac

SEQ ID NO: 13818 - RNA, 39 nt, synthetic construct
  misc_feature 1..39: note = derived and/or modified sequence opt1 from anti-HIV_CDR
  source 1..39: mol_type = other RNA
gacccccagatcgagatccgcggcaacgccttcgacatc

SEQ ID NO: 13819 - RNA, 39 nt, synthetic construct
  misc_feature 1..39: note = derived and/or modified sequence opt1 from anti-HIV_CDR
  source 1..39: mol_type = other RNA
gtgccccgcaccaccgccacgcggaacgccttcgacatc

SEQ ID NO: 13820 - RNA, 39 nt, synthetic construct
  misc_feature 1..39: note = derived and/or modified sequence opt1 from anti-HIV_CDR
  source 1..39: mol_type = other RNA
cacaagagcgtgctgctctggttccgcgagctggactac

SEQ ID NO: 13821 - RNA, 39 nt, synthetic construct
  misc_feature 1..39: note = derived and/or modified sequence opt1 from anti-HIV_CDR
  source 1..39: mol_type = other RNA
gacagcgaggactacgtggactactactacatggacgtc

SEQ ID NO: 13822 - RNA, 39 nt, synthetic construct
  misc_feature 1..39: note = derived and/or modified sequence opt1 from anti-HIV_CDR
  source 1..39: mol_type = other RNA
ctgccccgcaccaccggcatccggaacgccttcgacatc

SEQ ID NO: 13823 - RNA, 39 nt, synthetic construct
  misc_feature 1..39: note = derived and/or modified sequence opt1 from anti-HIV_CDR
  source 1..39: mol_type = other RNA
ctgccccgcaccaccggcatccggaacgccttcgacttc

SEQ ID NO: 13824 - RNA, 42 nt, synthetic construct
  misc_feature 1..42: note = derived and/or modified sequence opt1 from anti-HIV_CDR
  source 1..42: mol_type = other RNA
ggcaccctgtggttcggggagagcggcctccgcctggaccac

SEQ ID NO: 13825 - RNA, 42 nt, synthetic construct
  misc_feature 1..42: note = derived and/or modified sequence opt1 from anti-HIV_CDR
  source 1..42: mol_type = other RNA
gtggcctacgtccacgtggtgaccacccgcagcctggacaac

SEQ ID NO: 13826 - RNA, 42 nt, synthetic construct
  misc_feature 1..42: note = derived and/or modified sequence opt1 from anti-HIV_CDR
  source 1..42: mol_type = other RNA
gccgactacgacctgctcaccagctcctaccacttcgacagc

SEQ ID NO: 13827 - RNA, 42 nt, synthetic construct
  misc_feature 1..42: note = derived and/or modified sequence opt1 from anti-HIV_CDR
  source 1..42: mol_type = other RNA
acccgctgcttcggcgccaactgcttcaacttcatggacgtg

SEQ ID NO: 13828 - RNA, 42 nt, synthetic construct
  misc_feature 1..42: note = derived and/or modified sequence opt1 from anti-HIV_CDR
  source 1..42: mol_type = other RNA
ggcgggctgtactgcagctccatcagctgcatcatggacgtg

SEQ ID NO: 13829 - RNA, 42 nt, synthetic construct
  misc_feature 1..42: note = derived and/or modified sequence opt1 from anti-HIV_CDR
  source 1..42: mol_type = other RNA
aacgagccccagtaccacagcctgccgggcatgttcgactac

SEQ ID NO: 13830 - RNA, 42 nt, synthetic construct
  misc_feature 1..42: note = derived and/or modified sequence opt1 from anti-HIV_CDR
  source 1..42: mol_type = other RNA
gagccccgcgagatgggcaccctgaccgccgggttcgagtac

SEQ ID NO: 13831 - RNA, 42 nt, synthetic construct
  misc_feature 1..42: note = derived and/or modified sequence opt1 from anti-HIV_CDR
  source 1..42: mol_type = other RNA
gccaccggctacagctacgggtacctggacgccttcgacatc

SEQ ID NO: 13832 - RNA, 42 nt, synthetic construct
  misc_feature 1..42: note = derived and/or modified sequence opt1 from anti-HIV_CDR
  source 1..42: mol_type = other RNA
ggcagcctgtggttcggggagtccggcctccgcctggaccac

SEQ ID NO: 13833 - RNA, 42 nt, synthetic construct
  misc_feature 1..42: note = derived and/or modified sequence opt1 from anti-HIV_CDR
  source 1..42: mol_type = other RNA
gacaacaccatcagcggcgtggtcccccgctggttcgactac

SEQ ID NO: 13834 - RNA, 42 nt, synthetic construct
  misc_feature 1..42: note = derived and/or modified sequence opt1 from anti-HIV_CDR
  source 1..42: mol_type = other RNA
atctacgacggccgcgggtactacagctacttcttcgacctg

SEQ ID NO: 13835 - RNA, 42 nt, synthetic construct
  misc_feature 1..42: note = derived and/or modified sequence opt1 from anti-HIV_CDR
  source 1..42: mol_type = other RNA
gaccgcttcaactggaacgacggcgggtacttcttcgacagc

SEQ ID NO: 13836 - RNA, 42 nt, synthetic construct
  misc_feature 1..42: note = derived and/or modified sequence opt1 from anti-HIV_CDR
  source 1..42: mol_type = other RNA
ggccacagctccagctggaccaagttcaactggttcgggccc

SEQ ID NO: 13837 - RNA, 42 nt, synthetic construct
  misc_feature 1..42: note = derived and/or modified sequence opt1 from anti-HIV_CDR
  source 1..42: mol_type = other RNA
agcatcgccgccgacgactactactactactacatggacgtg

SEQ ID NO: 13838 - RNA, 42 nt, synthetic construct
  misc_feature 1..42: note = derived and/or modified sequence opt1 from anti-HIV_CDR
  source 1..42: mol_type = other RNA
agcttctacgacaacggcgggtactacctgggcctcgactac

SEQ ID NO: 13839 - RNA, 42 nt, synthetic construct
  misc_feature 1..42: note = derived and/or modified sequence opt1 from anti-HIV_CDR
  source 1..42: mol_type = other RNA
gacaaggacgccagcatctacggctaccgcatcctgaaccac

SEQ ID NO: 13840 - RNA, 42 nt, synthetic construct
  misc_feature 1..42: note = derived and/or modified sequence opt1 from anti-HIV_CDR
  source 1..42: mol_type = other RNA
gtgctgaccgacctcgaccagggcaacccccgcatggacgtc

SEQ ID NO: 13841 - RNA, 42 nt, synthetic construct
  misc_feature 1..42: note = derived and/or modified sequence opt1 from anti-HIV_CDR
  source 1..42: mol_type = other RNA
cgcgagatcaagttcggcgagctgagcttctacttcgactcc

SEQ ID NO: 13842 - RNA, 42 nt, synthetic construct
  misc_feature 1..42: note = derived and/or modified sequence opt1 from anti-HIV_CDR
  source 1..42: mol_type = other RNA
cgcgagatccggttcggcgagctgagcttctacttcgactac

SEQ ID NO: 13843 - RNA, 42 nt, synthetic construct
  misc_feature 1..42: note = derived and/or modified sequence opt1 from anti-HIV_CDR
  source 1..42: mol_type = other RNA
ccccacagcccgaccaacatcccctcccgccccctggactac

SEQ ID NO: 13844 - RNA, 42 nt, synthetic construct
  misc_feature 1..42: note = derived and/or modified sequence opt1 from anti-HIV_CDR
  source 1..42: mol_type = other RNA
ggcgactacgacatcctgaccagctcctaccagttcgactac

SEQ ID NO: 13845 - RNA, 42 nt, synthetic construct
  misc_feature 1..42: note = derived and/or modified sequence opt1 from anti-HIV_CDR
  source 1..42: mol_type = other RNA
agcacccccctggtgtggccgcccgccaacggcctcgacgtc

SEQ ID NO: 13846 - RNA, 42 nt, synthetic construct
  misc_feature 1..42: note = derived and/or modified sequence opt1 from anti-HIV_CDR
  source 1..42: mol_type = other RNA
acccgcaacaccggcaacagcctgccctactggttcgacctc

SEQ ID NO: 13847 - RNA, 45 nt, synthetic construct
  misc_feature 1..45: note = derived and/or modified sequence opt1 from anti-HIV_CDR
  source 1..45: mol_type = other RNA
gagaagggccagtggctgaccgtgcccccgtactacttcgacagc

SEQ ID NO: 13848 - RNA, 45 nt, synthetic construct
  misc_feature 1..45: note = derived and/or modified sequence opt1 from anti-HIV_CDR
  source 1..45: mol_type = other RNA
ggcagcgggcgctggaccatcggcgcccggatctacttcgacaac

SEQ ID NO: 13849 - RNA, 45 nt, synthetic construct
  misc_feature 1..45: note = derived and/or modified sequence opt1 from anti-HIV_CDR
  source 1..45: mol_type = other RNA
ctggaggccgacggcgccgactacagccccaagatgttcgacttc

SEQ ID NO: 13850 - RNA, 45 nt, synthetic construct
  misc_feature 1..45: note = derived and/or modified sequence opt1 from anti-HIV_CDR
  source 1..45: mol_type = other RNA
ctggaggccgacggcggggactacagccccaagatgttcgactac

SEQ ID NO: 13851 - RNA, 45 nt, synthetic construct
  misc_feature 1..45: note = derived and/or modified sequence opt1 from anti-HIV_CDR
  source 1..45: mol_type = other RNA
ctggaggccgacggcgacaactacagccccaagatggtggactac

SEQ ID NO: 13852 - RNA, 45 nt, synthetic construct
  misc_feature 1..45: note = derived and/or modified sequence opt1 from anti-HIV_CDR
  source 1..45: mol_type = other RNA
ctggaggccgacggcgacgactacagccccaagatgttcgactac

SEQ ID NO: 13853 - RNA, 45 nt, synthetic construct
  misc_feature 1..45: note = derived and/or modified sequence opt1 from anti-HIV_CDR
  source 1..45: mol_type = other RNA
ctggaggccgacggcagcgactactcccccaagatgttcgacttc

SEQ ID NO: 13854 - RNA, 45 nt, synthetic construct
  misc_feature 1..45: note = derived and/or modified sequence opt1 from anti-HIV_CDR
  source 1..45: mol_type = other RNA
ctggaggccgacggcgacgactacagccccaagatgttcgaccac

SEQ ID NO: 13855 - RNA, 45 nt, synthetic construct
  misc_feature 1..45: note = derived and/or modified sequence opt1 from anti-HIV_CDR
  source 1..45: mol_type = other RNA
ctggaggccgacggcgacgactacagccccaagatggtggactac

SEQ ID NO: 13856 - RNA, 45 nt, synthetic construct
  misc_feature 1..45: note = derived and/or modified sequence opt1 from anti-HIV_CDR
  source 1..45: mol_type = other RNA
gccccccgcctggacctcggcgagctgagctccgggttccacttc

SEQ ID NO: 13857 - RNA, 45 nt, synthetic construct
  misc_feature 1..45: note = derived and/or modified sequence opt1 from anti-HIV_CDR
  source 1..45: mol_type = other RNA
gccccccgcctggagctcggcgagctgagctccgggttccactac

SEQ ID NO: 13858 - RNA, 45 nt, synthetic construct
  misc_feature 1..45: note = derived and/or modified sequence opt1 from anti-HIV_CDR
  source 1..45: mol_type = other RNA
ggccggctgctcatgcagtggcccccgcgcgggggcttcgacccc

SEQ ID NO: 13859 - RNA, 45 nt, synthetic construct
  misc_feature 1..45: note = derived and/or modified sequence opt1 from anti-HIV_CDR
  source 1..45: mol_type = other RNA
ggccggctgttcatgcagtggcccccgcgcgggggcttcgacccc

SEQ ID NO: 13860 - RNA, 45 nt, synthetic construct
  misc_feature 1..45: note = derived and/or modified sequence opt1 from anti-HIV_CDR
  source 1..45: mol_type = other RNA
ggccgcctgttcgtgcagtggcccccgcagggcgggttcgacccc

SEQ ID NO: 13861 - RNA, 45 nt, synthetic construct
  misc_feature 1..45: note = derived and/or modified sequence opt1 from anti-HIV_CDR
  source 1..45: mol_type = other RNA
ggccgcctgttcatgcagtggcccccgcagggcgggttcgacccc

SEQ ID NO: 13862 - RNA, 45 nt, synthetic construct
  misc_feature 1..45: note = derived and/or modified sequence opt1 from anti-HIV_CDR
  source 1..45: mol_type = other RNA
ggccgcctgttcgtgcagtggcccccgcagggcgggttcgacacc

SEQ ID NO: 13863 - RNA, 45 nt, synthetic construct
  misc_feature 1..45: note = derived and/or modified sequence opt1 from anti-HIV_CDR
  source 1..45: mol_type = other RNA
aacaacaacacccgcaagagcatcaacatcggccccgggcgggcc

SEQ ID NO: 13864 - RNA, 45 nt, synthetic construct
  misc_feature 1..45: note = derived and/or modified sequence opt1 from anti-HIV_CDR
  source 1..45: mol_type = other RNA
cccggctactgcaacaacaacatctgcacccactggttcgacacc

SEQ ID NO: 13865 - RNA, 45 nt, synthetic construct
  misc_feature 1..45: note = derived and/or modified sequence opt1 from anti-HIV_CDR
  source 1..45: mol_type = other RNA
gacctgctccccgactacccggtgagctccgcccccgaggacttc

SEQ ID NO: 13866 - RNA, 45 nt, synthetic construct
  misc_feature 1..45: note = derived and/or modified sequence opt1 from anti-HIV_CDR
  source 1..45: mol_type = other RNA
gagagctggctgtactccaacggcgactactactacatggacgtg

SEQ ID NO: 13867 - RNA, 45 nt, synthetic construct
  misc_feature 1..45: note = derived and/or modified sequence opt1 from anti-HIV_CDR
  source 1..45: mol_type = other RNA
cgctactgcagctccaccacctgctaccggggccacttcgactac

SEQ ID NO: 13868 - RNA, 45 nt, synthetic construct
  misc_feature 1..45: note = derived and/or modified sequence opt1 from anti-HIV_CDR
  source 1..45: mol_type = other RNA
cagaccaccgacgagggccgccagtggctggtggggttccagcac

SEQ ID NO: 13869 - RNA, 45 nt, synthetic construct
  misc_feature 1..45: note = derived and/or modified sequence opt1 from anti-HIV_CDR
  source 1..45: mol_type = other RNA
cccagctacggcgggtacgacgaccagggctggtacttcgagtac

SEQ ID NO: 13870 - RNA, 45 nt, synthetic construct
  misc_feature 1..45: note = derived and/or modified sequence opt1 from anti-HIV_CDR
  source 1..45: mol_type = other RNA
gccgccatccccatcggcgacagcaagtactcctacttcgacagc

SEQ ID NO: 13871 - RNA, 45 nt, synthetic construct
  misc_feature 1..45: note = derived and/or modified sequence opt1 from anti-HIV_CDR
  source 1..45: mol_type = other RNA
gcccccccgcccggcagcaccgagtgggcctactacttcgactac

SEQ ID NO: 13872 - RNA, 45 nt, synthetic construct
  misc_feature 1..45: note = derived and/or modified sequence opt1 from anti-HIV_CDR
  source 1..45: mol_type = other RNA
gcccagttccacaacagcggctactactactccgggctggactac

SEQ ID NO: 13873 - RNA, 45 nt, synthetic construct
  misc_feature 1..45: note = derived and/or modified sequence opt1 from anti-HIV_CDR
  source 1..45: mol_type = other RNA
ggcgggtacgactacggcgaccactactactactacatggacgtg

SEQ ID NO: 13874 - RNA, 45 nt, synthetic construct
  misc_feature 1..45: note = derived and/or modified sequence opt1 from anti-HIV_CDR
  source 1..45: mol_type = other RNA
ggcacccagagctactccgccgtggcccccgggtggttcgacccg

SEQ ID NO: 13875 - RNA, 45 nt, synthetic construct
  misc_feature 1..45: note = derived and/or modified sequence opt1 from anti-HIV_CDR
  source 1..45: mol_type = other RNA
atcaaggggcccccgcgcggcaacttcggcgtggccttctacttc

SEQ ID NO: 13876 - RNA, 45 nt, synthetic construct
  misc_feature 1..45: note = derived and/or modified sequence opt1 from anti-HIV_CDR
  source 1..45: mol_type = other RNA
aaggtgtacagcgacggctggtccccgcccaccgggttcgtctac

SEQ ID NO: 13877 - RNA, 45 nt, synthetic construct
  misc_feature 1..45: note = derived and/or modified sequence opt1 from anti-HIV_CDR
  source 1..45: mol_type = other RNA
cgctacaagtacctgcccggcgaccagcacatgccgtgggacaac

SEQ ID NO: 13878 - RNA, 45 nt, synthetic construct
  misc_feature 1..45: note = derived and/or modified sequence opt1 from anti-HIV_CDR
  source 1..45: mol_type = other RNA
cgctacaagtacctgcccggcgaccagcacatgccgtgggactac

SEQ ID NO: 13879 - RNA, 45 nt, synthetic construct
  misc_feature 1..45: note = derived and/or modified sequence opt1 from anti-HIV_CDR
  source 1..45: mol_type = other RNA
ggcgggggctacgccgtggtcgggcccaagtacggcctggacgtg

SEQ ID NO: 13880 - RNA, 45 nt, synthetic construct
  misc_feature 1..45: note = derived and/or modified sequence opt1 from anti-HIV_CDR
  source 1..45: mol_type = other RNA
ctggacagctccagcggctgggaggaggtggggtacttcgaccgc

SEQ ID NO: 13881 - RNA, 45 nt, synthetic construct
  misc_feature 1..45: note = derived and/or modified sequence opt1 from anti-HIV_CDR
  source 1..45: mol_type = other RNA
gagaactacagcgacggctgggaggaggtggggcacttcgactac

SEQ ID NO: 13882 - RNA, 45 nt, synthetic construct
  misc_feature 1..45: note = derived and/or modified sequence opt1 from anti-HIV_CDR
  source 1..45: mol_type = other RNA
gagaactacagcgacggctgggaggaggtggggcacttcgactcc

SEQ ID NO: 13883 - RNA, 45 nt, synthetic construct
  misc_feature 1..45: note = derived and/or modified sequence opt1 from anti-HIV_CDR
  source 1..45: mol_type = other RNA
gagaactacagcgacggctggaacgaggtggggcacttcgacttc

SEQ ID NO: 13884 - RNA, 45 nt, synthetic construct
  misc_feature 1..45: note = derived and/or modified sequence opt1 from anti-HIV_CDR
  source 1..45: mol_type = other RNA
gagaactacagcgacggctggtacgaggtggggcacttcgacctg

SEQ ID NO: 13885 - RNA, 45 nt, synthetic construct
  misc_feature 1..45: note = derived and/or modified sequence opt1 from anti-HIV_CDR
  source 1..45: mol_type = other RNA
gaccgccggcgcttcctggagtggagcctctacggcatggacgtg

SEQ ID NO: 13886 - RNA, 45 nt, synthetic construct
  misc_feature 1..45: note = derived and/or modified sequence opt1 from anti-HIV_CDR
  source 1..45: mol_type = other RNA
ggcccccgcgtgttcttcgagagctccgggtactacttccgggac

SEQ ID NO: 13887 - RNA, 45 nt, synthetic construct
  misc_feature 1..45: note = derived and/or modified sequence opt1 from anti-HIV_CDR
  source 1..45: mol_type = other RNA
ggcccccgcgtgctgttcgagagctccgggcactacctccgggac

SEQ ID NO: 13888 - RNA, 45 nt, synthetic construct
  misc_feature 1..45: note = derived and/or modified sequence opt1 from anti-HIV_CDR
  source 1..45: mol_type = other RNA
ggcccccgcgtgttcttcgagagctccgggtactacttccggaac

SEQ ID NO: 13889 - RNA, 45 nt, synthetic construct
  misc_feature 1..45: note = derived and/or modified sequence opt1 from anti-HIV_CDR
  source 1..45: mol_type = other RNA
gagggcgggagcctgtggttcggcggggccaactggctcgacccc

SEQ ID NO: 13890 - RNA, 45 nt, synthetic construct
  misc_feature 1..45: note = derived and/or modified sequence opt1 from anti-HIV_CDR
  source 1..45: mol_type = other RNA
gccgactacgacaacatctgggacagccgcggcgggttcgacctg

SEQ ID NO: 13891 - RNA, 45 nt, synthetic construct
  misc_feature 1..45: note = derived and/or modified sequence opt1 from anti-HIV_CDR
  source 1..45: mol_type = other RNA
gtgggcgggaccgtctggagcggctactccaactacctggactac

SEQ ID NO: 13892 - RNA, 45 nt, synthetic construct
  misc_feature 1..45: note = derived and/or modified sequence opt1 from anti-HIV_CDR
  source 1..45: mol_type = other RNA
gacaaccgcgaccagtggctggtgctccggagctggttcgacccc

SEQ ID NO: 13893 - RNA, 45 nt, synthetic construct
  misc_feature 1..45: note = derived and/or modified sequence opt1 from anti-HIV_CDR
  source 1..45: mol_type = other RNA
gagaagggccagtgggtgaccctgcccccgtactacttcgacagc

SEQ ID NO: 13894 - RNA, 48 nt, synthetic construct
  misc_feature 1..48: note = derived and/or modified sequence opt1 from anti-HIV_CDR
  source 1..48: mol_type = other RNA
tacttcagcgacaccgaccgctccgagtacagcccctccctgcggagc

SEQ ID NO: 13895 - RNA, 48 nt, synthetic construct
  misc_feature 1..48: note = derived and/or modified sequence opt1 from anti-HIV_CDR
  source 1..48: mol_type = other RNA
tacatcagcgaccgcgagtccgccacctacaaccccagcctgaactcc

SEQ ID NO: 13896 - RNA, 48 nt, synthetic construct
  misc_feature 1..48: note = derived and/or modified sequence opt1 from anti-HIV_CDR
  source 1..48: mol_type = other RNA
tacttcagcgacaccgagaagtccaactacaaccccagcctgcgctcc

SEQ ID NO: 13897 - RNA, 48 nt, synthetic construct
  misc_feature 1..48: note = derived and/or modified sequence opt1 from anti-HIV_CDR
  source 1..48: mol_type = other RNA
tacatcagcgaccgcgcctccgccacctacaaccccagcctgaactcc

SEQ ID NO: 13898 - RNA, 48 nt, synthetic construct
  misc_feature 1..48: note = derived and/or modified sequence opt1 from anti-HIV_CDR
  source 1..48: mol_type = other RNA
tacgtgcaccacagcggcgacaccaactacaacccctccctgaagcgc

SEQ ID NO: 13899 - RNA, 48 nt, synthetic construct
  misc_feature 1..48: note = derived and/or modified sequence opt1 from anti-HIV_CDR
  source 1..48: mol_type = other RNA
tacgtgcacaagagcggcgacaccaactactcccccagcctgaagtcc

SEQ ID NO: 13900 - RNA, 48 nt, synthetic construct
  misc_feature 1..48: note = derived and/or modified sequence opt1 from anti-HIV_CDR
  source 1..48: mol_type = other RNA
tacgtgcacgacagcggcgacaccaactacaaccccagcctgaagtcc

SEQ ID NO: 13901 - RNA, 48 nt, synthetic construct
  misc_feature 1..48: note = derived and/or modified sequence opt1 from anti-HIV_CDR
  source 1..48: mol_type = other RNA
tacatcagcaagtccgagagcgccaactacaacccctccctgaacagc

SEQ ID NO: 13902 - RNA, 48 nt, synthetic construct
  misc_feature 1..48: note = derived and/or modified sequence opt1 from anti-HIV_CDR
  source 1..48: mol_type = other RNA
tacatctactacagcggctccaccaactacaaccccagcctgaagtcc

SEQ ID NO: 13903 - RNA, 48 nt, synthetic construct
  misc_feature 1..48: note = derived and/or modified sequence opt1 from anti-HIV_CDR
  source 1..48: mol_type = other RNA
tacgtgcacgacagcggcgacatcaactacaacccctccctgaagaac

SEQ ID NO: 13904 - RNA, 48 nt, synthetic construct
  misc_feature 1..48: note = derived and/or modified sequence opt1 from anti-HIV_CDR
  source 1..48: mol_type = other RNA
agctactacgacttctccatcggcgacgggaacgacgccttcgacgtg

SEQ ID NO: 13905 - RNA, 48 nt, synthetic construct
  misc_feature 1..48: note = derived and/or modified sequence opt1 from anti-HIV_CDR
  source 1..48: mol_type = other RNA
ggcttccgcgggagccccttctccagcggctccctgtacttcgacagc

SEQ ID NO: 13906 - RNA, 48 nt, synthetic construct
  misc_feature 1..48: note = derived and/or modified sequence opt1 from anti-HIV_CDR
  source 1..48: mol_type = other RNA
gtgatcagcggccgcatcaccatcttctactacaactacatcgacgtc

SEQ ID NO: 13907 - RNA, 48 nt, synthetic construct
  misc_feature 1..48: note = derived and/or modified sequence opt1 from anti-HIV_CDR
  source 1..48: mol_type = other RNA
gacggcctgggggaggtggcccccgactaccgctacggcatcgacgtc

SEQ ID NO: 13908 - RNA, 48 nt, synthetic construct
  misc_feature 1..48: note = derived and/or modified sequence opt1 from anti-HIV_CDR
  source 1..48: mol_type = other RNA
gacggcctgggggagctcgcccccgcctaccagtacggcatcgacgtg

SEQ ID NO: 13909 - RNA, 48 nt, synthetic construct
  misc_feature 1..48: note = derived and/or modified sequence opt1 from anti-HIV_CDR
  source 1..48: mol_type = other RNA
gacggcctgggggagctcgcccccgcctaccactacggcatcgacgtg

SEQ ID NO: 13910 - RNA, 48 nt, synthetic construct
  misc_feature 1..48: note = derived and/or modified sequence opt1 from anti-HIV_CDR
  source 1..48: mol_type = other RNA
gacggcctgggggaggtggcccccgcctacctctacggcatcgacgcg

SEQ ID NO: 13911 - RNA, 48 nt, synthetic construct
  misc_feature 1..48: note = derived and/or modified sequence opt1 from anti-HIV_CDR
  source 1..48: mol_type = other RNA
gccgtgaagggcttctggttcgacgaggtctacaactggttcgggccc

SEQ ID NO: 13912 - RNA, 48 nt, synthetic construct
  misc_feature 1..48: note = derived and/or modified sequence opt1 from anti-HIV_CDR
  source 1..48: mol_type = other RNA
gccgtgaagggcttctggttcgacgacccctacacctggttcgggccg

SEQ ID NO: 13913 - RNA, 48 nt, synthetic construct
  misc_feature 1..48: note = derived and/or modified sequence opt1 from anti-HIV_CDR
  source 1..48: mol_type = other RNA
gccgtgaagggcttctggttcgacgagcccagcacctggttcgggccg

SEQ ID NO: 13914 - RNA, 48 nt, synthetic construct
  misc_feature 1..48: note = derived and/or modified sequence opt1 from anti-HIV_CDR
  source 1..48: mol_type = other RNA
gccgtgaagggcctgtggttcgacgagacctacacctggttcgggccc

SEQ ID NO: 13915 - RNA, 48 nt, synthetic construct
  misc_feature 1..48: note = derived and/or modified sequence opt1 from anti-HIV_CDR
  source 1..48: mol_type = other RNA
gccgtggccggcctgtggttcgaggacgcgtacaactggttcgggccc

SEQ ID NO: 13916 - RNA, 48 nt, synthetic construct
  misc_feature 1..48: note = derived and/or modified sequence opt1 from anti-HIV_CDR
  source 1..48: mol_type = other RNA
gccgaggccgagagccagtcccacagccgccccatcatgttcgactac

SEQ ID NO: 13917 - RNA, 48 nt, synthetic construct
  misc_feature 1..48: note = derived and/or modified sequence opt1 from anti-HIV_CDR
  source 1..48: mol_type = other RNA
gccgaggccgcgagcgactcccacagccgccccatcatgttcgaccac

SEQ ID NO: 13918 - RNA, 48 nt, synthetic construct
  misc_feature 1..48: note = derived and/or modified sequence opt1 from anti-HIV_CDR
  source 1..48: mol_type = other RNA
ctggaggccgagagcgactcccacagccgccccatcatgttcgaccac

SEQ ID NO: 13919 - RNA, 48 nt, synthetic construct
  misc_feature 1..48: note = derived and/or modified sequence opt1 from anti-HIV_CDR
  source 1..48: mol_type = other RNA
gccgaggccgagagccagtcccacagccgccccatcatgttcgactcc

SEQ ID NO: 13920 - RNA, 48 nt, synthetic construct
  misc_feature 1..48: note = derived and/or modified sequence opt1 from anti-HIV_CDR
  source 1..48: mol_type = other RNA
gccgaggccgagagccagtcccacagccgccccatcatgttcgacttc

SEQ ID NO: 13921 - RNA, 48 nt, synthetic construct
  misc_feature 1..48: note = derived and/or modified sequence opt1 from anti-HIV_CDR
  source 1..48: mol_type = other RNA
gacaaccccctgctccagagcggcgagttctccagctccctggagaac

SEQ ID NO: 13922 - RNA, 48 nt, synthetic construct
  misc_feature 1..48: note = derived and/or modified sequence opt1 from anti-HIV_CDR
  source 1..48: mol_type = other RNA
gacaaccccctgctccagagcggcgagttctccagctccctggacaac

SEQ ID NO: 13923 - RNA, 48 nt, synthetic construct
  misc_feature 1..48: note = derived and/or modified sequence opt1 from anti-HIV_CDR
  source 1..48: mol_type = other RNA
ggccgcgactacaacttctggggcgggggcgggaagatcaacttcccc

SEQ ID NO: 13924 - RNA, 48 nt, synthetic construct
  misc_feature 1..48: note = derived and/or modified sequence opt1 from anti-HIV_CDR
  source 1..48: mol_type = other RNA
accaactgggccaacgacttcgtgaccggctactaccgcttcgacttc

SEQ ID NO: 13925 - RNA, 48 nt, synthetic construct
  misc_feature 1..48: note = derived and/or modified sequence opt1 from anti-HIV_CDR
  source 1..48: mol_type = other RNA
gccggccactgcagctccaccagctccgtgtactgccccttcgacatg

SEQ ID NO: 13926 - RNA, 48 nt, synthetic construct
  misc_feature 1..48: note = derived and/or modified sequence opt1 from anti-HIV_CDR
  source 1..48: mol_type = other RNA
caggtgagctcctacagctccagcggctaccgccgggagttcgactac

SEQ ID NO: 13927 - RNA, 48 nt, synthetic construct
  misc_feature 1..48: note = derived and/or modified sequence opt1 from anti-HIV_CDR
  source 1..48: mol_type = other RNA
cgcatggccaccctgaccggcgggtactactactactacatggacgtg

SEQ ID NO: 13928 - RNA, 48 nt, synthetic construct
  misc_feature 1..48: note = derived and/or modified sequence opt1 from anti-HIV_CDR
  source 1..48: mol_type = other RNA
gagggcgggtacagcgacttctggtccggctacagcgggttcgactac

SEQ ID NO: 13929 - RNA, 48 nt, synthetic construct
  misc_feature 1..48: note = derived and/or modified sequence opt1 from anti-HIV_CDR
  source 1..48: mol_type = other RNA
ctgtactacaacttcggcagcgggtacgacaccggcatcggggaccac

SEQ ID NO: 13930 - RNA, 48 nt, synthetic construct
  misc_feature 1..48: note = derived and/or modified sequence opt1 from anti-HIV_CDR
  source 1..48: mol_type = other RNA
gcccgcgagggccggtggttcagcgacaactactacgccatggacgtg

SEQ ID NO: 13931 - RNA, 48 nt, synthetic construct
  misc_feature 1..48: note = derived and/or modified sequence opt1 from anti-HIV_CDR
  source 1..48: mol_type = other RNA
gaccgcgtgggccggcgcctgggggagctcagcgccggcttcgactac

SEQ ID NO: 13932 - RNA, 48 nt, synthetic construct
  misc_feature 1..48: note = derived and/or modified sequence opt1 from anti-HIV_CDR
  source 1..48: mol_type = other RNA
gcccgcccccggagcccgtgggactccaccggctggagcgtggggtac

SEQ ID NO: 13933 - RNA, 48 nt, synthetic construct
  misc_feature 1..48: note = derived and/or modified sequence opt1 from anti-HIV_CDR
  source 1..48: mol_type = other RNA
agctactacgacttccgctccgacagcggcaacgacgccttcgacatc

SEQ ID NO: 13934 - RNA, 48 nt, synthetic construct
  misc_feature 1..48: note = derived and/or modified sequence opt1 from anti-HIV_CDR
  source 1..48: mol_type = other RNA
agctactacgacttccagaccgactccggcaacgacgccttcgacgtg

SEQ ID NO: 13935 - RNA, 48 nt, synthetic construct
  misc_feature 1..48: note = derived and/or modified sequence opt1 from anti-HIV_CDR
  source 1..48: mol_type = other RNA
gacaaccccgtgctgcagctcggcgagctgagctccagcctggactac

SEQ ID NO: 13936 - RNA, 48 nt, synthetic construct
  misc_feature 1..48: note = derived and/or modified sequence opt1 from anti-HIV_CDR
  source 1..48: mol_type = other RNA
ggcttccgcgggagccccttctccagcggctccatgtacttcgacagc

SEQ ID NO: 13937 - RNA, 48 nt, synthetic construct
  misc_feature 1..48: note = derived and/or modified sequence opt1 from anti-HIV_CDR
  source 1..48: mol_type = other RNA
ggcttccgcgggagccccctgtccagcggctccctctacttcgacagc

SEQ ID NO: 13938 - RNA, 48 nt, synthetic construct
  misc_feature 1..48: note = derived and/or modified sequence opt1 from anti-HIV_CDR
  source 1..48: mol_type = other RNA
ggcttccgcgggaacgtgttcagcaccggctggttctacctggacttc

SEQ ID NO: 13939 - RNA, 48 nt, synthetic construct
  misc_feature 1..48: note = derived and/or modified sequence opt1 from anti-HIV_CDR
  source 1..48: mol_type = other RNA
gaccgcctgagcttctccgtgcaggtcgagcagggcgtgctcgactac

SEQ ID NO: 13940 - RNA, 48 nt, synthetic construct
  misc_feature 1..48: note = derived and/or modified sequence opt1 from anti-HIV_CDR
  source 1..48: mol_type = other RNA
gaccgcctgagcttctccgtgcaggtcgagcagggcgtgctccagttc

SEQ ID NO: 13941 - RNA, 48 nt, synthetic construct
  misc_feature 1..48: note = derived and/or modified sequence opt1 from anti-HIV_CDR
  source 1..48: mol_type = other RNA
gtgctgagcggccgcatcaccatcttctactactactacatggacgtc

SEQ ID NO: 13942 - RNA, 51 nt, synthetic construct
  misc_feature 1..51: note = derived and/or modified sequence opt1 from anti-HIV_CDR
  source 1..51: mol_type = other RNA
tacatcagctccggcagctccaccctgcactacgccgacaccgtgaagggg

SEQ ID NO: 13943 - RNA, 51 nt, synthetic construct
  misc_feature 1..51: note = derived and/or modified sequence opt1 from anti-HIV_CDR
  source 1..51: mol_type = other RNA
cgctacctggactggagccccatcggccgggacacctacgggaccgacgtg

SEQ ID NO: 13944 - RNA, 51 nt, synthetic construct
  misc_feature 1..51: note = derived and/or modified sequence opt1 from anti-HIV_CDR
  source 1..51: mol_type = other RNA
cgctacttcgactggagccccttccggcgcgacacctacggcaccgacgtg

SEQ ID NO: 13945 - RNA, 51 nt, synthetic construct
  misc_feature 1..51: note = derived and/or modified sequence opt1 from anti-HIV_CDR
  source 1..51: mol_type = other RNA
ggccgcgactacaacttctggagcgggggcgggcggtactacttcgacttc

SEQ ID NO: 13946 - RNA, 51 nt, synthetic construct
  misc_feature 1..51: note = derived and/or modified sequence opt1 from anti-HIV_CDR
  source 1..51: mol_type = other RNA
ggcatccaggaggactacgacttctggcgcgagtaccgggagctggactac

SEQ ID NO: 13947 - RNA, 51 nt, synthetic construct
  misc_feature 1..51: note = derived and/or modified sequence opt1 from anti-HIV_CDR
  source 1..51: mol_type = other RNA
gtgctgaacaacaacacccgcaagagcatcaacatcggccccgggcgggcc

SEQ ID NO: 13948 - RNA, 51 nt, synthetic construct
  misc_feature 1..51: note = derived and/or modified sequence opt1 from anti-HIV_CDR
  source 1..51: mol_type = other RNA
gacctgaacttcggcgtggtcaccccctactactactactacctcgacgtg

SEQ ID NO: 13949 - RNA, 51 nt, synthetic construct
  misc_feature 1..51: note = derived and/or modified sequence opt1 from anti-HIV_CDR
  source 1..51: mol_type = other RNA
cacggccgcaccgtgttcggggtcgtgcggaactactactacatggacgtg

SEQ ID NO: 13950 - RNA, 51 nt, synthetic construct
  misc_feature 1..51: note = derived and/or modified sequence opt1 from anti-HIV_CDR
  source 1..51: mol_type = other RNA
cactactacggcagcgggctgaccaaggactactacgagtacatcgacgtg

SEQ ID NO: 13951 - RNA, 51 nt, synthetic construct
  misc_feature 1..51: note = derived and/or modified sequence opt1 from anti-HIV_CDR
  source 1..51: mol_type = other RNA
acctactacaacttctggagcgaccagtcccagggcctggacttcgactac

SEQ ID NO: 13952 - RNA, 51 nt, synthetic construct
  misc_feature 1..51: note = derived and/or modified sequence opt1 from anti-HIV_CDR
  source 1..51: mol_type = other RNA
ggcgtgtgggaggcccccgacgggagctcctactactactacatggccgac

SEQ ID NO: 13953 - RNA, 51 nt, synthetic construct
  misc_feature 1..51: note = derived and/or modified sequence opt1 from anti-HIV_CDR
  source 1..51: mol_type = other RNA
gaccagggcgggtaccccgtgagcccggtcggccccaagtggttcgacccc

SEQ ID NO: 13954 - RNA, 51 nt, synthetic construct
  misc_feature 1..51: note = derived and/or modified sequence opt1 from anti-HIV_CDR
  source 1..51: mol_type = other RNA
cgcgacaagtaccagtacatcgacagctccggcgactaccccttcgaccgg

SEQ ID NO: 13955 - RNA, 51 nt, synthetic construct
  misc_feature 1..51: note = derived and/or modified sequence opt1 from anti-HIV_CDR
  source 1..51: mol_type = other RNA
cagctgcgcgcccccaccacccggttccgccacggcgggtacttcgagaac

SEQ ID NO: 13956 - RNA, 51 nt, synthetic construct
  misc_feature 1..51: note = derived and/or modified sequence opt1 from anti-HIV_CDR
  source 1..51: mol_type = other RNA
caggtgcgcgcccccaccctgcggttccgccacggcgggtacttcgagacc

SEQ ID NO: 13957 - RNA, 51 nt, synthetic construct
  misc_feature 1..51: note = derived and/or modified sequence opt1 from anti-HIV_CDR
  source 1..51: mol_type = other RNA
gtgagcatcacctacgccggcctgatcgtcgtgcccggggccttcgacgtg

SEQ ID NO: 13958 - RNA, 51 nt, synthetic construct
  misc_feature 1..51: note = derived and/or modified sequence opt1 from anti-HIV_CDR
  source 1..51: mol_type = other RNA
gtggccatcagctacgccggcctgatcgtcgtgcccgggccgttcgacgtg

SEQ ID NO: 13959 - RNA, 51 nt, synthetic construct
  misc_feature 1..51: note = derived and/or modified sequence opt1 from anti-HIV_CDR
  source 1..51: mol_type = other RNA
agcctgaccggccgcctccacctgggggagctgtccagcggcatcgggccc

SEQ ID NO: 13960 - RNA, 51 nt, synthetic construct
  misc_feature 1..51: note = derived and/or modified sequence opt1 from anti-HIV_CDR
  source 1..51: mol_type = other RNA
ggcgggagcgccctgatcaccatcttcggcgtggaccccaagttcgacccg

SEQ ID NO: 13961 - RNA, 51 nt, synthetic construct
  misc_feature 1..51: note = derived and/or modified sequence opt1 from anti-HIV_CDR
  source 1..51: mol_type = other RNA
atggccctgaccagcggcccctacgacgtgtccgggtactacttcgactac

SEQ ID NO: 13962 - RNA, 51 nt, synthetic construct
  misc_feature 1..51: note = derived and/or modified sequence opt1 from anti-HIV_CDR
  source 1..51: mol_type = other RNA
atggccctggccagcggcccctacgacgtgtccgggtactacttcgactac

SEQ ID NO: 13963 - RNA, 51 nt, synthetic construct
  misc_feature 1..51: note = derived and/or modified sequence opt1 from anti-HIV_CDR
  source 1..51: mol_type = other RNA
atggccctgcccagcggcccgctcgaccgctccgggtactacttcgacgac

SEQ ID NO: 13964 - RNA, 54 nt, synthetic construct
  misc_feature 1..54: note = derived and/or modified sequence opt1 from anti-HIV_CDR
  source 1..54: mol_type = other RNA
gtggtccccatgttcagcatcttcggcgtggtgaaggccaactacttcgactac

SEQ ID NO: 13965 - RNA, 54 nt, synthetic construct
  misc_feature 1..54: note = derived and/or modified sequence opt1 from anti-HIV_CDR
  source 1..54: mol_type = other RNA
aaccgccgggtggccatgcccgaggccatgatcctgagcttctacatggacgtc

SEQ ID NO: 13966 - RNA, 54 nt, synthetic construct
  misc_feature 1..54: note = derived and/or modified sequence opt1 from anti-HIV_CDR
  source 1..54: mol_type = other RNA
ggcctgtgccgcgggggcaactgccggctcgggcccagcggctggctggacccg

SEQ ID NO: 13967 - RNA, 54 nt, synthetic construct
  misc_feature 1..54: note = derived and/or modified sequence opt1 from anti-HIV_CDR
  source 1..54: mol_type = other RNA
accccgccccactacgacgtgctgaccggctaccccagctccgtcctcgagttc

SEQ ID NO: 13968 - RNA, 54 nt, synthetic construct
  misc_feature 1..54: note = derived and/or modified sequence opt1 from anti-HIV_CDR
  source 1..54: mol_type = other RNA
atcccctaccacagcgagtcctactacaaggtggtcatcggcgggttcgacgtg

SEQ ID NO: 13969 - RNA, 54 nt, synthetic construct
  misc_feature 1..54: note = derived and/or modified sequence opt1 from anti-HIV_CDR
  source 1..54: mol_type = other RNA
gccgaccccttcaaggtggcccaggacgagggcctgttcgtcatcttcgactac

SEQ ID NO: 13970 - RNA, 54 nt, synthetic construct
  misc_feature 1..54: note = derived and/or modified sequence opt1 from anti-HIV_CDR
  source 1..54: mol_type = other RNA
gccgaccccttcaaggtggcccaggacgagggcctgtacgtcatcttcgactac

SEQ ID NO: 13971 - RNA, 54 nt, synthetic construct
  misc_feature 1..54: note = derived and/or modified sequence opt1 from anti-HIV_CDR
  source 1..54: mol_type = other RNA
gccgaccgcttcaaggtggcccaggacgagggcctgttcgtcatcttcgactac

SEQ ID NO: 13972 - RNA, 54 nt, synthetic construct
  misc_feature 1..54: note = derived and/or modified sequence opt1 from anti-HIV_CDR
  source 1..54: mol_type = other RNA
ggccgccagaccttccgggccatctggagcgggcccccggccgtgttcgacatc

SEQ ID NO: 13973 - RNA, 54 nt, synthetic construct
  misc_feature 1..54: note = derived and/or modified sequence opt1 from anti-HIV_CDR
  source 1..54: mol_type = other RNA
ggccgccagaccttccgggccatctggagcgggcccccggtggtcttcgacatc

SEQ ID NO: 13974 - RNA, 54 nt, synthetic construct
  misc_feature 1..54: note = derived and/or modified sequence opt1 from anti-HIV_CDR
  source 1..54: mol_type = other RNA
agccgcggcgactacaacttctggtccgggtaccccgagtaccacttcgaccgg

SEQ ID NO: 13975 - RNA, 54 nt, synthetic construct
  misc_feature 1..54: note = derived and/or modified sequence opt1 from anti-HIV_CDR
  source 1..54: mol_type = other RNA
ctgcccaagagccgcatggtgggcggggaccacctcccgttctaccccgacttc

SEQ ID NO: 13976 - RNA, 54 nt, synthetic construct
  misc_feature 1..54: note = derived and/or modified sequence opt1 from anti-HIV_CDR
  source 1..54: mol_type = other RNA
ctgaccggccccagcgggtactgcgactccagcggctgctactggttcgacccg

SEQ ID NO: 13977 - RNA, 54 nt, synthetic construct
  misc_feature 1..54: note = derived and/or modified sequence opt1 from anti-HIV_CDR
  source 1..54: mol_type = other RNA
ggcgggagcatgatccgcggcgtgccctccccgttctactacgggatggacgtc

SEQ ID NO: 13978 - RNA, 54 nt, synthetic construct
  misc_feature 1..54: note = derived and/or modified sequence opt1 from anti-HIV_CDR
  source 1..54: mol_type = other RNA
ctgttcggcgccaagcgcctcggggtggcccccagcggctactacatggacgtc

SEQ ID NO: 13979 - RNA, 54 nt, synthetic construct
  misc_feature 1..54: note = derived and/or modified sequence opt1 from anti-HIV_CDR
  source 1..54: mol_type = other RNA
gaccgctacgaggccgcctggttcggcgcggacaaggtgtacgggatggacgtc

SEQ ID NO: 13980 - RNA, 54 nt, synthetic construct
  misc_feature 1..54: note = derived and/or modified sequence opt1 from anti-HIV_CDR
  source 1..54: mol_type = other RNA
gagcaccgcctgcccccgcccaccggccggcgcacccggaactggttcgacccc

SEQ ID NO: 13981 - RNA, 54 nt, synthetic construct
  misc_feature 1..54: note = derived and/or modified sequence opt1 from anti-HIV_CDR
  source 1..54: mol_type = other RNA
ggccgcgggagcttccagggcttccagcagtacgagtactacgggatggacgtg

SEQ ID NO: 13982 - RNA, 54 nt, synthetic construct
  misc_feature 1..54: note = derived and/or modified sequence opt1 from anti-HIV_CDR
  source 1..54: mol_type = other RNA
ggccgcgggtacagccacggcttccagcagtacaactactacgggatggacgtg

SEQ ID NO: 13983 - RNA, 54 nt, synthetic construct
  misc_feature 1..54: note = derived and/or modified sequence opt1 from anti-HIV_CDR
  source 1..54: mol_type = other RNA
ggccgcgggagcttcaccggcttcgaccagtaccactactacgggatggacgtg

SEQ ID NO: 13984 - RNA, 54 nt, synthetic construct
  misc_feature 1..54: note = derived and/or modified sequence opt1 from anti-HIV_CDR
  source 1..54: mol_type = other RNA
ggccgcgggagcaccttcccctccgcccagttcagctacttcggcctggacgtg

SEQ ID NO: 13985 - RNA, 54 nt, synthetic construct
  misc_feature 1..54: note = derived and/or modified sequence opt1 from anti-HIV_CDR
  source 1..54: mol_type = other RNA
gacctggcccgctacggcgtgaccagcatcgtccccgagttcgggttcgacttc

SEQ ID NO: 13986 - RNA, 54 nt, synthetic construct
  misc_feature 1..54: note = derived and/or modified sequence opt1 from anti-HIV_CDR
  source 1..54: mol_type = other RNA
cgcggccggctgaacatccccagcccgtccgccatcctcaccgccttcgacgtg

SEQ ID NO: 13987 - RNA, 54 nt, synthetic construct
  misc_feature 1..54: note = derived and/or modified sequence opt1 from anti-HIV_CDR
  source 1..54: mol_type = other RNA
ggccccgggagcatggtgcgcggcctgatcgtcacctcctacgggatggacgtg

SEQ ID NO: 13988 - RNA, 54 nt, synthetic construct
  misc_feature 1..54: note = derived and/or modified sequence opt1 from anti-HIV_CDR
  source 1..54: mol_type = other RNA
aagcgcgtgaccatcttcggcgtcgtggacaccccccgggggtacttcgactac

SEQ ID NO: 13989 - RNA, 54 nt, synthetic construct
  misc_feature 1..54: note = derived and/or modified sequence opt1 from anti-HIV_CDR
  source 1..54: mol_type = other RNA
ggccagcgcaacgtgctgcacttcctcgagcggaagaacgacgccttcgacatc

SEQ ID NO: 13990 - RNA, 54 nt, synthetic construct
  misc_feature 1..54: note = derived and/or modified sequence opt1 from anti-HIV_CDR
  source 1..54: mol_type = other RNA
gagcagaaggactacgacttctggaacggcctgtacaagtacgggatggacgtg

SEQ ID NO: 13991 - RNA, 57 nt, synthetic construct
  misc_feature 1..57: note = derived and/or modified sequence opt1 from anti-HIV_CDR
  source 1..57: mol_type = other RNA
gacaccaccacgttcaccaccttcggcgggggccccaacatgggcgggttcgacccg

SEQ ID NO: 13992 - RNA, 57 nt, synthetic construct
  misc_feature 1..57: note = derived and/or modified sequence opt1 from anti-HIV_CDR
  source 1..57: mol_type = other RNA
gccggcctggactacaacttctggaacgggaagggccgcaagggggccttcgacgtg

SEQ ID NO: 13993 - RNA, 57 nt, synthetic construct
  misc_feature 1..57: note = derived and/or modified sequence opt1 from anti-HIV_CDR
  source 1..57: mol_type = other RNA
aacgaggccgactaccacgacggcaacgggcacagcctgcgcggcatgttcgactac

SEQ ID NO: 13994 - RNA, 57 nt, synthetic construct
  misc_feature 1..57: note = derived and/or modified sequence opt1 from anti-HIV_CDR
  source 1..57: mol_type = other RNA
aacgagccccagtaccacgacggcaacgggcacagcctgccgggcatgttcgactcc

SEQ ID NO: 13995 - RNA, 57 nt, synthetic construct
  misc_feature 1..57: note = derived and/or modified sequence opt1 from anti-HIV_CDR
  source 1..57: mol_type = other RNA
aacgagccccagtaccacgacgacaacggccacagcctgccggggatgatcgactac

SEQ ID NO: 13996 - RNA, 57 nt, synthetic construct
  misc_feature 1..57: note = derived and/or modified sequence opt1 from anti-HIV_CDR
  source 1..57: mol_type = other RNA
aacgagccccagtaccacgacggcaacgggcacagcctgccgggcatgttcgacttc

SEQ ID NO: 13997 - RNA, 57 nt, synthetic construct
  misc_feature 1..57: note = derived and/or modified sequence opt1 from anti-HIV_CDR
  source 1..57: mol_type = other RNA
aacgagccccagtacttcgacggcagcgggcactccctgccgggcatgttcgactac

SEQ ID NO: 13998 - RNA, 57 nt, synthetic construct
  misc_feature 1..57: note = derived and/or modified sequence opt1 from anti-HIV_CDR
  source 1..57: mol_type = other RNA
cgcgaggccgactaccacgacggcaacgggcacaccctgcccggcatgttcgacttc

SEQ ID NO: 13999 - RNA, 57 nt, synthetic construct
  misc_feature 1..57: note = derived and/or modified sequence opt1 from anti-HIV_CDR
  source 1..57: mol_type = other RNA
aacgagccccagtactacgacggcagcgggcactccctgccgggcatgttcgactac

SEQ ID NO: 14000 - RNA, 57 nt, synthetic construct
  misc_feature 1..57: note = derived and/or modified sequence opt1 from anti-HIV_CDR
  source 1..57: mol_type = other RNA
aacgagccccagtaccacgacggcaacgggcacagcctgccgggcatgttcgactac

SEQ ID NO: 14001 - RNA, 57 nt, synthetic construct
  misc_feature 1..57: note = derived and/or modified sequence opt1 from anti-HIV_CDR
  source 1..57: mol_type = other RNA
caggacagcgacttccacgacggccacgggcacaccctgcgcggcatgttcgactcc

SEQ ID NO: 14002 - RNA, 57 nt, synthetic construct
  misc_feature 1..57: note = derived and/or modified sequence opt1 from anti-HIV_CDR
  source 1..57: mol_type = other RNA
ctggactgggtgcgcggcgtcatgaacctcgtggagaaccactacgccatggacgtg

SEQ ID NO: 14003 - RNA, 57 nt, synthetic construct
  misc_feature 1..57: note = derived and/or modified sequence opt1 from anti-HIV_CDR
  source 1..57: mol_type = other RNA
accaacggcaccgagatcttccgccccgggggcggggacatgcgggacaactggcgc

SEQ ID NO: 14004 - RNA, 57 nt, synthetic construct
  misc_feature 1..57: note = derived and/or modified sequence opt1 from anti-HIV_CDR
  source 1..57: mol_type = other RNA
gacggccgctacagcggggacgaccagtactactaccactactactacatggacgtg

SEQ ID NO: 14005 - RNA, 57 nt, synthetic construct
  misc_feature 1..57: note = derived and/or modified sequence opt1 from anti-HIV_CDR
  source 1..57: mol_type = other RNA
ctgaccaagaaccccagccaggacttctggggctcctacctctactacttcgaggac

SEQ ID NO: 14006 - RNA, 57 nt, synthetic construct
  misc_feature 1..57: note = derived and/or modified sequence opt1 from anti-HIV_CDR
  source 1..57: mol_type = other RNA
ggcgccacctactactacgacagctccgggcaccagagccgccgggccttcgacatc

SEQ ID NO: 14007 - RNA, 57 nt, synthetic construct
  misc_feature 1..57: note = derived and/or modified sequence opt1 from anti-HIV_CDR
  source 1..57: mol_type = other RNA
gccttccaggccagcatggtgcgcggcgtcatcgtggacccctacgggatggacgtg

SEQ ID NO: 14008 - RNA, 57 nt, synthetic construct
  misc_feature 1..57: note = derived and/or modified sequence opt1 from anti-HIV_CDR
  source 1..57: mol_type = other RNA
caccgcgccgactacgacttctggaacggcagcaacctgcgggggtacttcgacccc

SEQ ID NO: 14009 - RNA, 57 nt, synthetic construct
  misc_feature 1..57: note = derived and/or modified sequence opt1 from anti-HIV_CDR
  source 1..57: mol_type = other RNA
caccgcgccaactacgacttctggggcgggagcaacctgcggggctacttcgacccc

SEQ ID NO: 14010 - RNA, 57 nt, synthetic construct
  misc_feature 1..57: note = derived and/or modified sequence opt1 from anti-HIV_CDR
  source 1..57: mol_type = other RNA
ggcttccacttctggagcgggaccggcacccgcccccggaactggtacttcgacctg

SEQ ID NO: 14011 - RNA, 57 nt, synthetic construct
  misc_feature 1..57: note = derived and/or modified sequence opt1 from anti-HIV_CDR
  source 1..57: mol_type = other RNA
aactacctgatcgagagccgctacgacgagaaggactactactacgccatggacgtg

SEQ ID NO: 14012 - RNA, 57 nt, synthetic construct
  misc_feature 1..57: note = derived and/or modified sequence opt1 from anti-HIV_CDR
  source 1..57: mol_type = other RNA
agccgcggctacgcctacgactccgggggccactacttccccacctggttcgacccg

SEQ ID NO: 14013 - RNA, 57 nt, synthetic construct
  misc_feature 1..57: note = derived and/or modified sequence opt1 from anti-HIV_CDR
  source 1..57: mol_type = other RNA
gacaccaccacgttcggcgccttcgggggcagccccaacatgggcgggctggacccg

SEQ ID NO: 14014 - RNA, 57 nt, synthetic construct
  misc_feature 1..57: note = derived and/or modified sequence opt1 from anti-HIV_CDR
  source 1..57: mol_type = other RNA
cacctggtggtcgccgtggccgcgggccccgactacttcagctacgggatggacgtg

SEQ ID NO: 14015 - RNA, 57 nt, synthetic construct
  misc_feature 1..57: note = derived and/or modified sequence opt1 from anti-HIV_CDR
  source 1..57: mol_type = other RNA
gacaccaccacgttcagctccttcggcagcccgcccaacatgggcgggctggacccc

SEQ ID NO: 14016 - RNA, 57 nt, synthetic construct
  misc_feature 1..57: note = derived and/or modified sequence opt1 from anti-HIV_CDR
  source 1..57: mol_type = other RNA
gacaccaccacgttcggcgccttcgggggcggggccaacatgggcgggctggacccc

SEQ ID NO: 14017 - RNA, 57 nt, synthetic construct
  misc_feature 1..57: note = derived and/or modified sequence opt1 from anti-HIV_CDR
  source 1..57: mol_type = other RNA
gacaccaccacgttcaccagcttcggctccccgccccgcatgggcgggctggacccc

SEQ ID NO: 14018 - RNA, 57 nt, synthetic construct
  misc_feature 1..57: note = derived and/or modified sequence opt1 from anti-HIV_CDR
  source 1..57: mol_type = other RNA
gacaccaccacgttcagctccttcggcagcccgccccacatgggcgggctggacccc

SEQ ID NO: 14019 - RNA, 57 nt, synthetic construct
  misc_feature 1..57: note = derived and/or modified sequence opt1 from anti-HIV_CDR
  source 1..57: mol_type = other RNA
gaccgcgtgagcgactacgacttctggtccggcaagcgggggtacggcatggacgtc

SEQ ID NO: 14020 - RNA, 57 nt, synthetic construct
  misc_feature 1..57: note = derived and/or modified sequence opt1 from anti-HIV_CDR
  source 1..57: mol_type = other RNA
gagctgagcggcgagtaccacttctggtccgggacctaccgctacggcgtggacgtc

SEQ ID NO: 14021 - RNA, 57 nt, synthetic construct
  misc_feature 1..57: note = derived and/or modified sequence opt1 from anti-HIV_CDR
  source 1..57: mol_type = other RNA
cacggcgccagcgagaactacgggcccggctcctacagcgccgagcacttccagcac

SEQ ID NO: 14022 - RNA, 57 nt, synthetic construct
  misc_feature 1..57: note = derived and/or modified sequence opt1 from anti-HIV_CDR
  source 1..57: mol_type = other RNA
cacggcgccagcgccaactacgggcccggctcctacagcgcggagcacttccagcac

SEQ ID NO: 14023 - RNA, 60 nt, synthetic construct
  misc_feature 1..60: note = derived and/or modified sequence opt1 from anti-HIV_CDR
  source 1..60: mol_type = other RNA
cacgaggccccccgctacagctacgccttccggcgctactaccactacggcctggacgtg

SEQ ID NO: 14024 - RNA, 60 nt, synthetic construct
  misc_feature 1..60: note = derived and/or modified sequence opt1 from anti-HIV_CDR
  source 1..60: mol_type = other RNA
accagcacctacgaccagtggtccggcctgcaccacgacggggtgatggccttcagctcc

SEQ ID NO: 14025 - RNA, 60 nt, synthetic construct
  misc_feature 1..60: note = derived and/or modified sequence opt1 from anti-HIV_CDR
  source 1..60: mol_type = other RNA
ggcgagttcgacagctccgggttcgactacgagagctggtacccctactacatggacgtg

SEQ ID NO: 14026 - RNA, 60 nt, synthetic construct
  misc_feature 1..60: note = derived and/or modified sequence opt1 from anti-HIV_CDR
  source 1..60: mol_type = other RNA
ggccagaccgacctgaacgacgacttctggagcgagtactccacccccgggttcgactac

SEQ ID NO: 14027 - RNA, 60 nt, synthetic construct
  misc_feature 1..60: note = derived and/or modified sequence opt1 from anti-HIV_CDR
  source 1..60: mol_type = other RNA
ggccagaccgacctgaacgacgacctctggagcgactactccacccccgggttcgactac

SEQ ID NO: 14028 - RNA, 60 nt, synthetic construct
  misc_feature 1..60: note = derived and/or modified sequence opt1 from anti-HIV_CDR
  source 1..60: mol_type = other RNA
aacctgatcgaggagagccagacccagcaggagatcaacgagcgcgacctcctggccctg

SEQ ID NO: 14029 - RNA, 60 nt, synthetic construct
  misc_feature 1..60: note = derived and/or modified sequence opt1 from anti-HIV_CDR
  source 1..60: mol_type = other RNA
aacctgatcgaggagagccagatccagcaggagaagaacgagaaggagctcctggagctg

SEQ ID NO: 14030 - RNA, 60 nt, synthetic construct
  misc_feature 1..60: note = derived and/or modified sequence opt1 from anti-HIV_CDR
  source 1..60: mol_type = other RNA
agcctgatcgagaactcccagatccagcaggagaagaacgagcaggacctcctgcagctg

SEQ ID NO: 14031 - RNA, 60 nt, synthetic construct
  misc_feature 1..60: note = derived and/or modified sequence opt1 from anti-HIV_CDR
  source 1..60: mol_type = other RNA
agcctgatcgaggagtcccagatccagcaggagaagaacgagaaggagctcctggagctg

SEQ ID NO: 14032 - RNA, 60 nt, synthetic construct
  misc_feature 1..60: note = derived and/or modified sequence opt1 from anti-HIV_CDR
  source 1..60: mol_type = other RNA
cgcctgatcgaggagagccagacccagcaggagaagaacgagcaggagctcctggagctg

SEQ ID NO: 14033 - RNA, 60 nt, synthetic construct
  misc_feature 1..60: note = derived and/or modified sequence opt1 from anti-HIV_CDR
  source 1..60: mol_type = other RNA
agcctgatcgaggagtcccagacccagcaggagaagaacgagaaggagctcctggagctg

SEQ ID NO: 14034 - RNA, 60 nt, synthetic construct
  misc_feature 1..60: note = derived and/or modified sequence opt1 from anti-HIV_CDR
  source 1..60: mol_type = other RNA
aacctgctcgaggagagccagaaccagcaggagaagaacgagcaggagctgctggagctc

SEQ ID NO: 14035 - RNA, 60 nt, synthetic construct
  misc_feature 1..60: note = derived and/or modified sequence opt1 from anti-HIV_CDR
  source 1..60: mol_type = other RNA
accctgatcgaggagagccagaaccagcaggagaagaacgagctcgagctgctggagctc

SEQ ID NO: 14036 - RNA, 60 nt, synthetic construct
  misc_feature 1..60: note = derived and/or modified sequence opt1 from anti-HIV_CDR
  source 1..60: mol_type = other RNA
accctgcaggaggagagccagaaccagcaggagaagaacgagcaggagctcctggagctg

SEQ ID NO: 14037 - RNA, 60 nt, synthetic construct
  misc_feature 1..60: note = derived and/or modified sequence opt1 from anti-HIV_CDR
  source 1..60: mol_type = other RNA
agcctgctcgaggagtcccagaaccagcaggagaagaacgagcaggagctgctggagctc

SEQ ID NO: 14038 - RNA, 60 nt, synthetic construct
  misc_feature 1..60: note = derived and/or modified sequence opt1 from anti-HIV_CDR
  source 1..60: mol_type = other RNA
accctgatcgaggagagccagaaccagcaggagaagaaccagcaggagctcctgcagctg

SEQ ID NO: 14039 - RNA, 60 nt, synthetic construct
  misc_feature 1..60: note = derived and/or modified sequence opt1 from anti-HIV_CDR
  source 1..60: mol_type = other RNA
accctgatcgaggagagccagaaccagcaggagaagaacgagcaggagctcctgggcctg

SEQ ID NO: 14040 - RNA, 60 nt, synthetic construct
  misc_feature 1..60: note = derived and/or modified sequence opt1 from anti-HIV_CDR
  source 1..60: mol_type = other RNA
accctgatcgaggagagccagaaccagcaggagaagaacgagcaggagctcctggagctg

SEQ ID NO: 14041 - RNA, 60 nt, synthetic construct
  misc_feature 1..60: note = derived and/or modified sequence opt1 from anti-HIV_CDR
  source 1..60: mol_type = other RNA
agcctgatcgaggactcccagatccagcaggagaagaacgagaaggagctcctggagctg

SEQ ID NO: 14042 - RNA, 60 nt, synthetic construct
  misc_feature 1..60: note = derived and/or modified sequence opt1 from anti-HIV_CDR
  source 1..60: mol_type = other RNA
agcctgctcgagaagtcccagacccagcaggagaagaacgagcaggagctgctggagctc

SEQ ID NO: 14043 - RNA, 60 nt, synthetic construct
  misc_feature 1..60: note = derived and/or modified sequence opt1 from anti-HIV_CDR
  source 1..60: mol_type = other RNA
agcctgatcgaggagtcccagaaccagcaggagaagaacgagcaggagctcctggagctg

SEQ ID NO: 14044 - RNA, 60 nt, synthetic construct
  misc_feature 1..60: note = derived and/or modified sequence opt1 from anti-HIV_CDR
  source 1..60: mol_type = other RNA
ggcgacctgctcgggtacaccgacagctggtacgagttcgactactactacatggacgtg

SEQ ID NO: 14045 - RNA, 60 nt, synthetic construct
  misc_feature 1..60: note = derived and/or modified sequence opt1 from anti-HIV_CDR
  source 1..60: mol_type = other RNA
gacaccaacggcaccgagatcttccgccccgggggcggggacatgcgggacaactggcgc

SEQ ID NO: 14046 - RNA, 60 nt, synthetic construct
  misc_feature 1..60: note = derived and/or modified sequence opt1 from anti-HIV_CDR
  source 1..60: mol_type = other RNA
gacgtggtcgagcgccccggcttcggggacttccggtacgactactacggcatggacgtg

SEQ ID NO: 14047 - RNA, 60 nt, synthetic construct
  misc_feature 1..60: note = derived and/or modified sequence opt1 from anti-HIV_CDR
  source 1..60: mol_type = other RNA
gaccagcgcgactgcagcaccaaccggtgcttcggcgtgttcgggtactacatggacgtc

SEQ ID NO: 14048 - RNA, 60 nt, synthetic construct
  misc_feature 1..60: note = derived and/or modified sequence opt1 from anti-HIV_CDR
  source 1..60: mol_type = other RNA
gaccgctgggtgcggccccagttcccgagcatggacttccagtacaacggcctggacgtc

SEQ ID NO: 14049 - RNA, 60 nt, synthetic construct
  misc_feature 1..60: note = derived and/or modified sequence opt1 from anti-HIV_CDR
  source 1..60: mol_type = other RNA
gacagcggcttcgacctggactactacgacaccaacgagctctacttcgggttcgactac

SEQ ID NO: 14050 - RNA, 60 nt, synthetic construct
  misc_feature 1..60: note = derived and/or modified sequence opt1 from anti-HIV_CDR
  source 1..60: mol_type = other RNA
aagtaccccgcctactacgacatcctgaccgccaactaccgcagctactacttcgactac

SEQ ID NO: 14051 - RNA, 60 nt, synthetic construct
  misc_feature 1..60: note = derived and/or modified sequence opt1 from anti-HIV_CDR
  source 1..60: mol_type = other RNA
aagtaccccgcctactacgacatcctgaccggctactaccgcaactactacttcgactac

SEQ ID NO: 14052 - RNA, 60 nt, synthetic construct
  misc_feature 1..60: note = derived and/or modified sequence opt1 from anti-HIV_CDR
  source 1..60: mol_type = other RNA
cgcgtgaagttccccctgtggttcggcgagaccacctactactactacgggatggacgtc

SEQ ID NO: 14053 - RNA, 60 nt, synthetic construct
  misc_feature 1..60: note = derived and/or modified sequence opt1 from anti-HIV_CDR
  source 1..60: mol_type = other RNA
gagcgcagcaccaagtactccttctggagcgccgtgatgcggcccgacgccttcgacctg

SEQ ID NO: 14054 - RNA, 60 nt, synthetic construct
  misc_feature 1..60: note = derived and/or modified sequence opt1 from anti-HIV_CDR
  source 1..60: mol_type = other RNA
cacgaggccccccgctacagctacgccttccggaactactaccactacggcctggacgtg

SEQ ID NO: 14055 - RNA, 60 nt, synthetic construct
  misc_feature 1..60: note = derived and/or modified sequence opt1 from anti-HIV_CDR
  source 1..60: mol_type = other RNA
gagaacgtgctgatggagagcgacgactacaacgactactactactactacatggacgtc

SEQ ID NO: 14056 - RNA, 60 nt, synthetic construct
  misc_feature 1..60: note = derived and/or modified sequence opt1 from anti-HIV_CDR
  source 1..60: mol_type = other RNA
gagcgcgtgctggtcttccccgaccaggacgccgactactactactacttcttcgacgtg

SEQ ID NO: 14057 - RNA, 60 nt, synthetic construct
  misc_feature 1..60: note = derived and/or modified sequence opt1 from anti-HIV_CDR
  source 1..60: mol_type = other RNA
gagcgcgtgctggtcgtgcccgaccaggacgccgactactactactacttcttcgacgtg

SEQ ID NO: 14058 - RNA, 63 nt, synthetic construct
  misc_feature 1..63: note = derived and/or modified sequence opt1 from anti-HIV_CDR
  source 1..63: mol_type = other RNA
gaccgcagctccgccatcggctactgcagctccatcagctgctacaaggggtccttcgacatc

SEQ ID NO: 14059 - RNA, 63 nt, synthetic construct
  misc_feature 1..63: note = derived and/or modified sequence opt1 from anti-HIV_CDR
  source 1..63: mol_type = other RNA
gtggtcaagatcgagcccctgggcgtggccccgaccaaggccaagcgcgtggcgcgggagaag

SEQ ID NO: 14060 - RNA, 63 nt, synthetic construct
  misc_feature 1..63: note = derived and/or modified sequence opt1 from anti-HIV_CDR
  source 1..63: mol_type = other RNA
gtggtccgcatcgagcccctgggcgtggccccgaccaaggccaagcgggtggagcgcgagaag

SEQ ID NO: 14061 - RNA, 63 nt, synthetic construct
  misc_feature 1..63: note = derived and/or modified sequence opt1 from anti-HIV_CDR
  source 1..63: mol_type = other RNA
gtggtccgcatcgagcccctgggcatcgccccgacccgggccaagcgcgtggagcgggagaag

SEQ ID NO: 14062 - RNA, 63 nt, synthetic construct
  misc_feature 1..63: note = derived and/or modified sequence opt1 from anti-HIV_CDR
  source 1..63: mol_type = other RNA
gtggtcaagatcgagcccatcggcgtggccccgaccaaggcccgccgggtggagcgcgagaag

SEQ ID NO: 14063 - RNA, 63 nt, synthetic construct
  misc_feature 1..63: note = derived and/or modified sequence opt1 from anti-HIV_CDR
  source 1..63: mol_type = other RNA
gtggtcaagatcgagcccctgggcgtggccccgacccgcgccaagcgggtggagcgcgagaag

SEQ ID NO: 14064 - RNA, 63 nt, synthetic construct
  misc_feature 1..63: note = derived and/or modified sequence opt1 from anti-HIV_CDR
  source 1..63: mol_type = other RNA
gtggtccagatcgagcccctgggcgtggccccgacccgcgccaagcgggtggagcgcgagaag

SEQ ID NO: 14065 - RNA, 63 nt, synthetic construct
  misc_feature 1..63: note = derived and/or modified sequence opt1 from anti-HIV_CDR
  source 1..63: mol_type = other RNA
gtggtccgcatcgagcccctgggcgtggccccgaccaaggccaagcgggtgcagcgcgagaag

SEQ ID NO: 14066 - RNA, 63 nt, synthetic construct
  misc_feature 1..63: note = derived and/or modified sequence opt1 from anti-HIV_CDR
  source 1..63: mol_type = other RNA
gtggtcaagatcgagcccctgggcgtggccccgaccaaggccaagcgcgtgcagcggaagaag

SEQ ID NO: 14067 - RNA, 63 nt, synthetic construct
  misc_feature 1..63: note = derived and/or modified sequence opt1 from anti-HIV_CDR
  source 1..63: mol_type = other RNA
gtgatcaagatcgagcccctgatcgtcgccccgaccaaggccaagcgcgtgcagcgggagaag

SEQ ID NO: 14068 - RNA, 63 nt, synthetic construct
  misc_feature 1..63: note = derived and/or modified sequence opt1 from anti-HIV_CDR
  source 1..63: mol_type = other RNA
gtggtcaagatcgagcccctgggcgtggccccgaccaaggcccgccgggtgcagcgcgagaag

SEQ ID NO: 14069 - RNA, 63 nt, synthetic construct
  misc_feature 1..63: note = derived and/or modified sequence opt1 from anti-HIV_CDR
  source 1..63: mol_type = other RNA
gtggtcaagatcgagctgctcggcgtggcccccaccaaggccaagcgcgtgcagcgggagaag

SEQ ID NO: 14070 - RNA, 63 nt, synthetic construct
  misc_feature 1..63: note = derived and/or modified sequence opt1 from anti-HIV_CDR
  source 1..63: mol_type = other RNA
gtggtcaccatcgagcccctgggcgtggccccgaccaaggccaagcgcgtgcagcgggagaag

SEQ ID NO: 14071 - RNA, 63 nt, synthetic construct
  misc_feature 1..63: note = derived and/or modified sequence opt1 from anti-HIV_CDR
  source 1..63: mol_type = other RNA
gtggtcaagatcgagcccctgggcgtggccccgaccaaggccaagcgcgtgcagcgggagaag

SEQ ID NO: 14072 - RNA, 63 nt, synthetic construct
  misc_feature 1..63: note = derived and/or modified sequence opt1 from anti-HIV_CDR
  source 1..63: mol_type = other RNA
gacctggtgagcgtctccccgccctacggcaactacgggcccgacaacaactggttcgacttc

SEQ ID NO: 14073 - RNA, 63 nt, synthetic construct
  misc_feature 1..63: note = derived and/or modified sequence opt1 from anti-HIV_CDR
  source 1..63: mol_type = other RNA
atgaacccgccctggttccgcggcgggagcaacaacccctactcctactactacatggacgtg

SEQ ID NO: 14074 - RNA, 63 nt, synthetic construct
  misc_feature 1..63: note = derived and/or modified sequence opt1 from anti-HIV_CDR
  source 1..63: mol_type = other RNA
gactggatcggctacgactacgacgggagcggctcccacctgcgcgacgagagcttcgacatc

SEQ ID NO: 14075 - RNA, 63 nt, synthetic construct
  misc_feature 1..63: note = derived and/or modified sequence opt1 from anti-HIV_CDR
  source 1..63: mol_type = other RNA
tgcagcatcgtgggcaacggggacttcctggaggaggactcccactaccccgccatggacgtc

SEQ ID NO: 14076 - RNA, 63 nt, synthetic construct
  misc_feature 1..63: note = derived and/or modified sequence opt1 from anti-HIV_CDR
  source 1..63: mol_type = other RNA
gacttcgtgagcatctacggcgtcgcctacttcaccgggggcgggccctccagcccggacatc

SEQ ID NO: 14077 - RNA, 66 nt, synthetic construct
  misc_feature 1..66: note = derived and/or modified sequence opt1 from anti-HIV_CDR
  source 1..66: mol_type = other RNA
aaggccaaggactactactacgagagctccgactacagcccctactactactactacatggacgtg

SEQ ID NO: 14078 - RNA, 66 nt, synthetic construct
  misc_feature 1..66: note = derived and/or modified sequence opt1 from anti-HIV_CDR
  source 1..66: mol_type = other RNA
gaccacggcatcaagcccgacaactactacgacatcagcgggtacaacctggactacttcgactac

SEQ ID NO: 14079 - RNA, 66 nt, synthetic construct
  misc_feature 1..66: note = derived and/or modified sequence opt1 from anti-HIV_CDR
  source 1..66: mol_type = other RNA
ggcagcctgtacgactaccgcgacaacgccgacctcaagccctcctactactacgccatggacgtg

SEQ ID NO: 14080 - RNA, 66 nt, synthetic construct
  misc_feature 1..66: note = derived and/or modified sequence opt1 from anti-HIV_CDR
  source 1..66: mol_type = other RNA
gacgaggccagctgggtggaggccgcggacgagtgggacgagcacctgttccgcgagatggccgtc

SEQ ID NO: 14081 - RNA, 66 nt, synthetic construct
  misc_feature 1..66: note = derived and/or modified sequence opt1 from anti-HIV_CDR
  source 1..66: mol_type = other RNA
gacgaggtgagctgggtcgaggccgccgacgagtgggacgagcacctgttccgcgagatggcggtg

SEQ ID NO: 14082 - RNA, 66 nt, synthetic construct
  misc_feature 1..66: note = derived and/or modified sequence opt1 from anti-HIV_CDR
  source 1..66: mol_type = other RNA
gacgagggcagctgggtggaggccgccgacgagtgggacgagcacctgttccgcgagatggcggtc

SEQ ID NO: 14083 - RNA, 66 nt, synthetic construct
  misc_feature 1..66: note = derived and/or modified sequence opt1 from anti-HIV_CDR
  source 1..66: mol_type = other RNA
gaccagcgcggccggtacagcttcgggttcgtgaccggccagaccaaggtctccgccatcagcgac

SEQ ID NO: 14084 - RNA, 66 nt, synthetic construct
  misc_feature 1..66: note = derived and/or modified sequence opt1 from anti-HIV_CDR
  source 1..66: mol_type = other RNA
gaccagctgggccgctacagcttcgggttcgtgaccggccagaacaaggtctccgccatcagcgac

SEQ ID NO: 14085 - RNA, 66 nt, synthetic construct
  misc_feature 1..66: note = derived and/or modified sequence opt1 from anti-HIV_CDR
  source 1..66: mol_type = other RNA
gaccaggtgggccgctacagcttcgggttcgccaccggccagcagcgggtctccgccatcagcgac

SEQ ID NO: 14086 - RNA, 69 nt, synthetic construct
  misc_feature 1..69: note = derived and/or modified sequence opt1 from anti-HIV_CDR
  source 1..69: mol_type = other RNA
gtggtcaagatcgagcccctgggcgtggccccgaccaaggccaagcgccgggtggtccagcgcgagaag

SEQ ID NO: 14087 - RNA, 69 nt, synthetic construct
  misc_feature 1..69: note = derived and/or modified sequence opt1 from anti-HIV_CDR
  source 1..69: mol_type = other RNA
cgcatcagctccagctcctggtacatggtggacaacagccacaccctgcacttctactacatggacgtc

SEQ ID NO: 14088 - RNA, 69 nt, synthetic construct
  misc_feature 1..69: note = derived and/or modified sequence opt1 from anti-HIV_CDR
  source 1..69: mol_type = other RNA
gacaagcccgcctacgacgagtacgccgaggagaccatcgcgccgcacaactaccacgccatggacctg

SEQ ID NO: 14089 - RNA, 69 nt, synthetic construct
  misc_feature 1..69: note = derived and/or modified sequence opt1 from anti-HIV_CDR
  source 1..69: mol_type = other RNA
cagaacatcgccgcccgcgcggccgagaagctgtacgagaacgactactacttctacggcatggacgtg

SEQ ID NO: 14090 - RNA, 69 nt, synthetic construct
  misc_feature 1..69: note = derived and/or modified sequence opt1 from anti-HIV_CDR
  source 1..69: mol_type = other RNA
cagaacatcgccgcccgcaccgcggagcggctgtacgagaacgactactacttctacggcatggacgtg

SEQ ID NO: 14091 - RNA, 72 nt, synthetic construct
  misc_feature 1..72: note = derived and/or modified sequence opt1 from anti-HIV_CDR
  source 1..72: mol_type = other RNA
gcccagcagggcaagcgcatctacgggatcgtgagcttcggcgagttcttctactactactacatggacgcc

SEQ ID NO: 14092 - RNA, 72 nt, synthetic construct
  misc_feature 1..72: note = derived and/or modified sequence opt1 from anti-HIV_CDR
  source 1..72: mol_type = other RNA
acccagcagggcaagcgcatctacggggtggtcagcttcggcgagttcttccactactactacatggacgcc

SEQ ID NO: 14093 - RNA, 72 nt, synthetic construct
  misc_feature 1..72: note = derived and/or modified sequence opt1 from anti-HIV_CDR
  source 1..72: mol_type = other RNA
gcccgccggggccagcgcatctacggggtggtcagcttcggcgagttcttctactactactccatggacgtg

SEQ ID NO: 14094 - RNA, 72 nt, synthetic construct
  misc_feature 1..72: note = derived and/or modified sequence opt1 from anti-HIV_CDR
  source 1..72: mol_type = other RNA
accctgcacggccgccggatctacgggatcgtggccttcaacgagtggttcacctacttctacatggacgtc

SEQ ID NO: 14095 - RNA, 72 nt, synthetic construct
  misc_feature 1..72: note = derived and/or modified sequence opt1 from anti-HIV_CDR
  source 1..72: mol_type = other RNA
accaagcacggccgccggatctacgggatcgtggccttcaacgagtggttcacctacttctacatggacgtc

SEQ ID NO: 14096 - RNA, 72 nt, synthetic construct
  misc_feature 1..72: note = derived and/or modified sequence opt1 from anti-HIV_CDR
  source 1..72: mol_type = other RNA
gcccgccacggccagcggatctacggggtggtcagcttcggcgagttcttcacctactactccatggacgtg

SEQ ID NO: 14097 - RNA, 72 nt, synthetic construct
  misc_feature 1..72: note = derived and/or modified sequence opt1 from anti-HIV_CDR
  source 1..72: mol_type = other RNA
acccagcagggcaagcgcatctacggggtggtcagcttcggcgactactactactactactacatggacgtg

SEQ ID NO: 14098 - RNA, 72 nt, synthetic construct
  misc_feature 1..72: note = derived and/or modified sequence opt1 from anti-HIV_CDR
  source 1..72: mol_type = other RNA
accaagcacggccgccggatctacggggtggtcgccttcggcgagtggttcacctacttctacatggacgtg

SEQ ID NO: 14099 - RNA, 72 nt, synthetic construct
  misc_feature 1..72: note = derived and/or modified sequence opt1 from anti-HIV_CDR
  source 1..72: mol_type = other RNA
gccgtgatcaccgacctgcacaccttcggcgactacgagctcgaggaccccagctactactacatggacgtc

SEQ ID NO: 14100 - RNA, 72 nt, synthetic construct
  misc_feature 1..72: note = derived and/or modified sequence opt1 from anti-HIV_CDR
  source 1..72: mol_type = other RNA
gaccgcggcgacacccggctgctcgactacggggactacgaggacgagcgctactactacggcatggacgtg

SEQ ID NO: 14101 - RNA, 72 nt, synthetic construct
  misc_feature 1..72: note = derived and/or modified sequence opt1 from anti-HIV_CDR
  source 1..72: mol_type = other RNA
ggcacccgctacgacttctggagcgggttctccaaccgggacggccgcgccctggccgggtacttcgactac

SEQ ID NO: 14102 - RNA, 72 nt, synthetic construct
  misc_feature 1..72: note = derived and/or modified sequence opt1 from anti-HIV_CDR
  source 1..72: mol_type = other RNA
gacggcaaggggaaggcctactacgacttctggagcggctaccgcaaccagaagtactacgggctggacgtg

SEQ ID NO: 14103 - RNA, 72 nt, synthetic construct
  misc_feature 1..72: note = derived and/or modified sequence opt1 from anti-HIV_CDR
  source 1..72: mol_type = other RNA
gccgtgatcaccgacctgcacaccttcgccgactacgagctcggcgaccccagctacttctacatggacgtc

SEQ ID NO: 14104 - RNA, 72 nt, synthetic construct
  misc_feature 1..72: note = derived and/or modified sequence opt1 from anti-HIV_CDR
  source 1..72: mol_type = other RNA
agcgtgatcaccgacctgcacaccttcggcgactacgagtccggggaccccagctactactacatggacgtc

SEQ ID NO: 14105 - RNA, 81 nt, synthetic construct
  misc_feature 1..81: note = derived and/or modified sequence opt1 from anti-HIV_CDR
  source 1..81: mol_type = other RNA
gacttcccccgcttccaccggctggtgggcaactacgacttctggcgcgggaccctcgaccggttcagctacatggacctg

SEQ ID NO: 14106 - RNA, 105 nt, synthetic construct
  misc_feature 1..105: note = derived and/or modified sequence opt1 from anti-HIV_CDR
  source 1..105: mol_type = other RNA
cgcatcctggccgtggagcggtacctcaaggaccagcagctgctgggcatctgggggtgcagcggcaagatcatctgccccaccatggtcccgtggaactccagc

SEQ ID NO: 14107 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctccaggaccagcgcctgctgggcatgtgggggtgcagcggcaagcacatctgcaccaccttcgtgccctggaactccagc

SEQ ID NO: 14108 - RNA, 105 nt, synthetic construct
  misc_feature 1..105: note = derived and/or modified sequence opt1 from anti-HIV_CDR
  source 1..105: mol_type = other RNA
cgcgtgctggccgtcgagagctacctcaaggaccagcagctgctgggcatctgggggtgctccggcaagcacatctgcaccaccacggtgccctggaacagctcc

SEQ ID NO: 14109 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctccgcgaccagcagctgctgggcatctgggggtgcagcggccggcacatctgcaccaccaacgtgccctggaactccagc

SEQ ID NO: 14110 - RNA, 105 nt, synthetic construct
  misc_feature 1..105: note = derived and/or modified sequence opt1 from anti-HIV_CDR
  source 1..105: mol_type = other RNA
cgcatcctggccgtggagcggtacctcaaggaccagcagctgctgggcatctgggggtgcagcggcaagctcatctgcaccaccacggtcccctggaactccagc

SEQ ID NO: 14111 - RNA, 105 nt, synthetic construct
  misc_feature 1..105: note = derived and/or modified sequence opt1 from anti-HIV_CDR
  source 1..105: mol_type = other RNA
cgcatcctggccgtggagcggtacctcaaggaccagcagctgctgggcatctgggggtgcagcggcaagcacatctgcaccaccaacgtcccctggaactccagc

SEQ ID NO: 14112 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctccgcgaccagcagctgctgggcatctgggggtgcagcggcaagctcatctgcaccaccacggtgccctggaacgcctcc

SEQ ID NO: 14113 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctccgcgaccagcagctgctgggcatctgggggtgcagcggcaagctcatctgcaccaccgccgtgccctggaacgcgtcc

SEQ ID NO: 14114 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctcaaggaccagcagctgctgggcatctgggggtgcagcggcaagctcatctgcaccaccacggtgccctggaacgcctcc

SEQ ID NO: 14115 - RNA, 105 nt, synthetic construct
  misc_feature 1..105: note = derived and/or modified sequence opt1 from anti-HIV_CDR
  source 1..105: mol_type = other RNA
cgcatcctggccgtggagcggtacctcaaggaccagcagctgctgggcttctgggggtgcagcggcaagctcatctgcaccaccgccgtcccctggaacgcgtcc

SEQ ID NO: 14116 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctccgcgaccagcagctgctgggcatctgggggtgcagcggcaagctcatctgcaccaccacggtgccctggaacacctcc

SEQ ID NO: 14117 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctcaaggaccagcagctgctgggcatctgggggtgcagcggcaagctcatctgcaccaccgccgtgccctggaacgcgtcc

SEQ ID NO: 14118 - RNA, 105 nt, synthetic construct
  misc_feature 1..105: note = derived and/or modified sequence opt1 from anti-HIV_CDR
  source 1..105: mol_type = other RNA
cgcgtgctggccgtcgagcggtacctcaaggaccagcagctgctgggcttctgggggtgcagcggcaagctcatctgcaccaccacggtgccctggaacgcctcc

SEQ ID NO: 14119 - RNA, 105 nt, synthetic construct
  misc_feature 1..105: note = derived and/or modified sequence opt1 from anti-HIV_CDR
  source 1..105: mol_type = other RNA
cgcatcctggccgtggagcggtacctcaaggaccagcagctgctgggcatctgggggtgcagcggcaagctcatctgcaccaccgccgtcccctggaacgcgtcc

SEQ ID NO: 14120-14145 - skipped (26 entries)

SEQ ID NO: 14146 - RNA, 12 nt, synthetic construct
  misc_feature 1..12: note = derived and/or modified sequence opt1 from anti-influenza_CDR
  source 1..12: mol_type = other RNA
gacgtgcccgac

SEQ ID NO: 14147 - RNA, 12 nt, synthetic construct
  misc_feature 1..12: note = derived and/or modified sequence opt1 from anti-influenza_CDR
  source 1..12: mol_type = other RNA
cgcctgagcggc

SEQ ID NO: 14148 - RNA, 12 nt, synthetic construct
  misc_feature 1..12: note = derived and/or modified sequence opt1 from anti-influenza_CDR
  source 1..12: mol_type = other RNA
ttctgggacctg

SEQ ID NO: 14149 - RNA, 15 nt, synthetic construct
  misc_feature 1..15: note = derived and/or modified sequence opt1 from anti-influenza_CDR
  source 1..15: mol_type = other RNA
accggcctgcgcaac

SEQ ID NO: 14150 - RNA, 15 nt, synthetic construct
  misc_feature 1..15: note = derived and/or modified sequence opt1 from anti-influenza_CDR
  source 1..15: mol_type = other RNA
cagcagagccgcacc

SEQ ID NO: 14151 - RNA, 15 nt, synthetic construct
  misc_feature 1..15: note = derived and/or modified sequence opt1 from anti-influenza_CDR
  source 1..15: mol_type = other RNA
cagctgagccgcacc

SEQ ID NO: 14152 - RNA, 15 nt, synthetic construct
  misc_feature 1..15: note = derived and/or modified sequence opt1 from anti-influenza_CDR
  source 1..15: mol_type = other RNA
agcaactacatcacc

SEQ ID NO: 14153 - RNA, 15 nt, synthetic construct
  misc_feature 1..15: note = derived and/or modified sequence opt1 from anti-influenza_CDR
  source 1..15: mol_type = other RNA
gactacagctggaac

SEQ ID NO: 14154 - RNA, 15 nt, synthetic construct
  misc_feature 1..15: note = derived and/or modified sequence opt1 from anti-influenza_CDR
  source 1..15: mol_type = other RNA
aactacgccttcagc

SEQ ID NO: 14155 - RNA, 15 nt, synthetic construct
  misc_feature 1..15: note = derived and/or modified sequence opt1 from anti-influenza_CDR
  source 1..15: mol_type = other RNA
aagaacgccatcagc

SEQ ID NO: 14156 - RNA, 15 nt, synthetic construct
  misc_feature 1..15: note = derived and/or modified sequence opt1 from anti-influenza_CDR
  source 1..15: mol_type = other RNA
agccactggatgacc

SEQ ID NO: 14157 - RNA, 15 nt, synthetic construct
  misc_feature 1..15: note = derived and/or modified sequence opt1 from anti-influenza_CDR
  source 1..15: mol_type = other RNA
aactacgacatcaac

SEQ ID NO: 14158 - RNA, 15 nt, synthetic construct
  misc_feature 1..15: note = derived and/or modified sequence opt1 from anti-influenza_CDR
  source 1..15: mol_type = other RNA
gactacggcgtgacc

SEQ ID NO: 14159 - RNA, 15 nt, synthetic construct
  misc_feature 1..15: note = derived and/or modified sequence opt1 from anti-influenza_CDR
  source 1..15: mol_type = other RNA
aactacggcatcaac

SEQ ID NO: 14160 - RNA, 15 nt, synthetic construct
  misc_feature 1..15: note = derived and/or modified sequence opt1 from anti-influenza_CDR
  source 1..15: mol_type = other RNA
ggctacaccatcacc

SEQ ID NO: 14161 - RNA, 15 nt, synthetic construct
  misc_feature 1..15: note = derived and/or modified sequence opt1 from anti-influenza_CDR
  source 1..15: mol_type = other RNA
aactacggcatcagc

SEQ ID NO: 14162 - RNA, 15 nt, synthetic construct
  misc_feature 1..15: note = derived and/or modified sequence opt1 from anti-influenza_CDR
  source 1..15: mol_type = other RNA
gacgactactggacc

SEQ ID NO: 14163 - RNA, 15 nt, synthetic construct
  misc_feature 1..15: note = derived and/or modified sequence opt1 from anti-influenza_CDR
  source 1..15: mol_type = other RNA
acctacgccatgcac

SEQ ID NO: 14164 - RNA, 15 nt, synthetic construct
  misc_feature 1..15: note = derived and/or modified sequence opt1 from anti-influenza_CDR
  source 1..15: mol_type = other RNA
agctacgccatgcac

SEQ ID NO: 14165 - RNA, 15 nt, synthetic construct
  misc_feature 1..15: note = derived and/or modified sequence opt1 from anti-influenza_CDR
  source 1..15: mol_type = other RNA
agctactactggaac

SEQ ID NO: 14166 - RNA, 15 nt, synthetic construct
  misc_feature 1..15: note = derived and/or modified sequence opt1 from anti-influenza_CDR
  source 1..15: mol_type = other RNA
acctaccccgtggcc

SEQ ID NO: 14167 - RNA, 15 nt, synthetic construct
  misc_feature 1..15: note = derived and/or modified sequence opt1 from anti-influenza_CDR
  source 1..15: mol_type = other RNA
cactacttctggagc

SEQ ID NO: 14168 - RNA, 15 nt, synthetic construct
  misc_feature 1..15: note = derived and/or modified sequence opt1 from anti-influenza_CDR
  source 1..15: mol_type = other RNA
gactactactggacc

SEQ ID NO: 14169 - RNA, 15 nt, synthetic construct
  misc_feature 1..15: note = derived and/or modified sequence opt1 from anti-influenza_CDR
  source 1..15: mol_type = other RNA
gactactactggagc

SEQ ID NO: 14170 - RNA, 15 nt, synthetic construct
  misc_feature 1..15: note = derived and/or modified sequence opt1 from anti-influenza_CDR
  source 1..15: mol_type = other RNA
ggctactacatgcac

SEQ ID NO: 14171 - RNA, 15 nt, synthetic construct
  misc_feature 1..15: note = derived and/or modified sequence opt1 from anti-influenza_CDR
  source 1..15: mol_type = other RNA
agccactactggtcc

SEQ ID NO: 14172 - RNA, 15 nt, synthetic construct
  misc_feature 1..15: note = derived and/or modified sequence opt1 from anti-influenza_CDR
  source 1..15: mol_type = other RNA
aactactggatcggc

SEQ ID NO: 14173 - RNA, 15 nt, synthetic construct
  misc_feature 1..15: note = derived and/or modified sequence opt1 from anti-influenza_CDR
  source 1..15: mol_type = other RNA
aactacgccatcatc

SEQ ID NO: 14174 - RNA, 15 nt, synthetic construct
  misc_feature 1..15: note = derived and/or modified sequence opt1 from anti-influenza_CDR
  source 1..15: mol_type = other RNA
gactactacatccac

SEQ ID NO: 14175 - RNA, 15 nt, synthetic construct
  misc_feature 1..15: note = derived and/or modified sequence opt1 from anti-influenza_CDR
  source 1..15: mol_type = other RNA
ggctacgacatgcac

SEQ ID NO: 14176 - RNA, 15 nt, synthetic construct
  misc_feature 1..15: note = derived and/or modified sequence opt1 from anti-influenza_CDR
  source 1..15: mol_type = other RNA
ggctactacatccac

SEQ ID NO: 14177 - RNA, 15 nt, synthetic construct
  misc_feature 1..15: note = derived and/or modified sequence opt1 from anti-influenza_CDR
  source 1..15: mol_type = other RNA
ggctactacgtgcac

SEQ ID NO: 14178 - RNA, 15 nt, synthetic construct
  misc_feature 1..15: note = derived and/or modified sequence opt1 from anti-influenza_CDR
  source 1..15: mol_type = other RNA
aactactggatgagc

SEQ ID NO: 14179 - RNA, 15 nt, synthetic construct
  misc_feature 1..15: note = derived and/or modified sequence opt1 from anti-influenza_CDR
  source 1..15: mol_type = other RNA
ggcgagagcaccctg

SEQ ID NO: 14180 - RNA, 15 nt, synthetic construct
  misc_feature 1..15: note = derived and/or modified sequence opt1 from anti-influenza_CDR
  source 1..15: mol_type = other RNA
aactactactggagc

SEQ ID NO: 14181 - RNA, 15 nt, synthetic construct
  misc_feature 1..15: note = derived and/or modified sequence opt1 from anti-influenza_CDR
  source 1..15: mol_type = other RNA
agcaactacatgtcc

SEQ ID NO: 14182 - RNA, 15 nt, synthetic construct
  misc_feature 1..15: note = derived and/or modified sequence opt1 from anti-influenza_CDR
  source 1..15: mol_type = other RNA
agcgactactggtcc

SEQ ID NO: 14183 - RNA, 15 nt, synthetic construct
  misc_feature 1..15: note = derived and/or modified sequence opt1 from anti-influenza_CDR
  source 1..15: mol_type = other RNA
agctacaactggatc

SEQ ID NO: 14184 - RNA, 15 nt, synthetic construct
  misc_feature 1..15: note = derived and/or modified sequence opt1 from anti-influenza_CDR
  source 1..15: mol_type = other RNA
agcacctacatgaac

SEQ ID NO: 14185 - RNA, 15 nt, synthetic construct
  misc_feature 1..15: note = derived and/or modified sequence opt1 from anti-influenza_CDR
  source 1..15: mol_type = other RNA
aactacgccatgagc

SEQ ID NO: 14186 - RNA, 15 nt, synthetic construct
  misc_feature 1..15: note = derived and/or modified sequence opt1 from anti-influenza_CDR
  source 1..15: mol_type = other RNA
agcgacttctggtcc

SEQ ID NO: 14187 - RNA, 15 nt, synthetic construct
  misc_feature 1..15: note = derived and/or modified sequence opt1 from anti-influenza_CDR
  source 1..15: mol_type = other RNA
tactacgccatgagc

SEQ ID NO: 14188 - RNA, 15 nt, synthetic construct
  misc_feature 1..15: note = derived and/or modified sequence opt1 from anti-influenza_CDR
  source 1..15: mol_type = other RNA
ggctactacgtgtac

SEQ ID NO: 14189 - RNA, 15 nt, synthetic construct
  misc_feature 1..15: note = derived and/or modified sequence opt1 from anti-influenza_CDR
  source 1..15: mol_type = other RNA
agctacgccatctcc

SEQ ID NO: 14190 - RNA, 15 nt, synthetic construct
  misc_feature 1..15: note = derived and/or modified sequence opt1 from anti-influenza_CDR
  source 1..15: mol_type = other RNA
agctactcctggagc

SEQ ID NO: 14191 - RNA, 15 nt, synthetic construct
  misc_feature 1..15: note = derived and/or modified sequence opt1 from anti-influenza_CDR
  source 1..15: mol_type = other RNA
aacagcttctggggc

SEQ ID NO: 14192 - RNA, 15 nt, synthetic construct
  misc_feature 1..15: note = derived and/or modified sequence opt1 from anti-influenza_CDR
  source 1..15: mol_type = other RNA
gcctaccactggagc

SEQ ID NO: 14193 - RNA, 15 nt, synthetic construct
  misc_feature 1..15: note = derived and/or modified sequence opt1 from anti-influenza_CDR
  source 1..15: mol_type = other RNA
gacaactacatcaac

SEQ ID NO: 14194 - RNA, 15 nt, synthetic construct
  misc_feature 1..15: note = derived and/or modified sequence opt1 from anti-influenza_CDR
  source 1..15: mol_type = other RNA
agcggcttctccgtg

SEQ ID NO: 14195 - RNA, 15 nt, synthetic construct
  misc_feature 1..15: note = derived and/or modified sequence opt1 from anti-influenza_CDR
  source 1..15: mol_type = other RNA
gcctacgccttcacc

SEQ ID NO: 14196 - RNA, 15 nt, synthetic construct
  misc_feature 1..15: note = derived and/or modified sequence opt1 from anti-influenza_CDR
  source 1..15: mol_type = other RNA
ggcagcgccatctcc

SEQ ID NO: 14197 - RNA, 15 nt, synthetic construct
  misc_feature 1..15: note = derived and/or modified sequence opt1 from anti-influenza_CDR
  source 1..15: mol_type = other RNA
agctacgccatcacc

SEQ ID NO: 14198 - RNA, 15 nt, synthetic construct
  misc_feature 1..15: note = derived and/or modified sequence opt1 from anti-influenza_CDR
  source 1..15: mol_type = other RNA
agctactacatgcac

SEQ ID NO: 14199 - RNA, 15 nt, synthetic construct
  misc_feature 1..15: note = derived and/or modified sequence opt1 from anti-influenza_CDR
  source 1..15: mol_type = other RNA
atctacgccatgagc

SEQ ID NO: 14200 - RNA, 15 nt, synthetic construct
  misc_feature 1..15: note = derived and/or modified sequence opt1 from anti-influenza_CDR
  source 1..15: mol_type = other RNA
agctactccatgaac

SEQ ID NO: 14201 - RNA, 15 nt, synthetic construct
  misc_feature 1..15: note = derived and/or modified sequence opt1 from anti-influenza_CDR
  source 1..15: mol_type = other RNA
agctacggcatctcc

SEQ ID NO: 14202 - RNA, 15 nt, synthetic construct
  misc_feature 1..15: note = derived and/or modified sequence opt1 from anti-influenza_CDR
  source 1..15: mol_type = other RNA
ttctacagcatgtcc

SEQ ID NO: 14203 - RNA, 15 nt, synthetic construct
  misc_feature 1..15: note = derived and/or modified sequence opt1 from anti-influenza_CDR
  source 1..15: mol_type = other RNA
acccacgccatcagc

SEQ ID NO: 14204 - RNA, 15 nt, synthetic construct
  misc_feature 1..15: note = derived and/or modified sequence opt1 from anti-influenza_CDR
  source 1..15: mol_type = other RNA
ggctacgccatcagc

SEQ ID NO: 14205 - RNA, 15 nt, synthetic construct
  misc_feature 1..15: note = derived and/or modified sequence opt1 from anti-influenza_CDR
  source 1..15: mol_type = other RNA
agcaactccatcagc

SEQ ID NO: 14206 - RNA, 15 nt, synthetic construct
  misc_feature 1..15: note = derived and/or modified sequence opt1 from anti-influenza_CDR
  source 1..15: mol_type = other RNA
aacttcgccatcaac

SEQ ID NO: 14207 - RNA, 15 nt, synthetic construct
  misc_feature 1..15: note = derived and/or modified sequence opt1 from anti-influenza_CDR
  source 1..15: mol_type = other RNA
agcaacgccgtgtcc

SEQ ID NO: 14208 - RNA, 15 nt, synthetic construct
  misc_feature 1..15: note = derived and/or modified sequence opt1 from anti-influenza_CDR
  source 1..15: mol_type = other RNA
gacaacgccatcagc

SEQ ID NO: 14209 - RNA, 15 nt, synthetic construct
  misc_feature 1..15: note = derived and/or modified sequence opt1 from anti-influenza_CDR
  source 1..15: mol_type = other RNA
ttcagcgaggtggag

SEQ ID NO: 14210 - RNA, 15 nt, synthetic construct
  misc_feature 1..15: note = derived and/or modified sequence opt1 from anti-influenza_CDR
  source 1..15: mol_type = other RNA
gcccaccacatgcac

SEQ ID NO: 14211 - RNA, 15 nt, synthetic construct
  misc_feature 1..15: note = derived and/or modified sequence opt1 from anti-influenza_CDR
  source 1..15: mol_type = other RNA
agccagtggatcggc

SEQ ID NO: 14212 - RNA, 15 nt, synthetic construct
  misc_feature 1..15: note = derived and/or modified sequence opt1 from anti-influenza_CDR
  source 1..15: mol_type = other RNA
gactacgccatgaac

SEQ ID NO: 14213 - RNA, 15 nt, synthetic construct
  misc_feature 1..15: note = derived and/or modified sequence opt1 from anti-influenza_CDR
  source 1..15: mol_type = other RNA
aacgcctggatgagc

SEQ ID NO: 14214 - RNA, 15 nt, synthetic construct
  misc_feature 1..15: note = derived and/or modified sequence opt1 from anti-influenza_CDR
  source 1..15: mol_type = other RNA
gactacgccatcaac

SEQ ID NO: 14215 - RNA, 15 nt, synthetic construct
  misc_feature 1..15: note = derived and/or modified sequence opt1 from anti-influenza_CDR
  source 1..15: mol_type = other RNA
cgccacggcatcagc

SEQ ID NO: 14216 - RNA, 15 nt, synthetic construct
  misc_feature 1..15: note = derived and/or modified sequence opt1 from anti-influenza_CDR
  source 1..15: mol_type = other RNA
gagctgagcatccac

SEQ ID NO: 14217 - RNA, 15 nt, synthetic construct
  misc_feature 1..15: note = derived and/or modified sequence opt1 from anti-influenza_CDR
  source 1..15: mol_type = other RNA
agctccaactactac

SEQ ID NO: 14218 - RNA, 15 nt, synthetic construct
  misc_feature 1..15: note = derived and/or modified sequence opt1 from anti-influenza_CDR
  source 1..15: mol_type = other RNA
acctacgccatgagc

SEQ ID NO: 14219 - RNA, 15 nt, synthetic construct
  misc_feature 1..15: note = derived and/or modified sequence opt1 from anti-influenza_CDR
  source 1..15: mol_type = other RNA
aactacgccatcagc

SEQ ID NO: 14220 - RNA, 18 nt, synthetic construct
  misc_feature 1..18: note = derived and/or modified sequence opt1 from anti-influenza_CDR
  source 1..18: mol_type = other RNA
ttcggcgccatcgccggg

SEQ ID NO: 14221 - RNA, 18 nt, synthetic construct
  misc_feature 1..18: note = derived and/or modified sequence opt1 from anti-influenza_CDR
  source 1..18: mol_type = other RNA
caggacatcagccgctac

SEQ ID NO: 14222 - RNA, 18 nt, synthetic construct
  misc_feature 1..18: note = derived and/or modified sequence opt1 from anti-influenza_CDR
  source 1..18: mol_type = other RNA
cagaacatcggcccctgg

SEQ ID NO: 14223 - RNA, 18 nt, synthetic construct
  misc_feature 1..18: note = derived and/or modified sequence opt1 from anti-influenza_CDR
  source 1..18: mol_type = other RNA
cagagcgtgaaccgccgg

SEQ ID NO: 14224 - RNA, 18 nt, synthetic construct
  misc_feature 1..18: note = derived and/or modified sequence opt1 from anti-influenza_CDR
  source 1..18: mol_type = other RNA
cagagcatctccacctac

SEQ ID NO: 14225 - RNA, 18 nt, synthetic construct
  misc_feature 1..18: note = derived and/or modified sequence opt1 from anti-influenza_CDR
  source 1..18: mol_type = other RNA
cagggcatcatcacctac

SEQ ID NO: 14226 - RNA, 18 nt, synthetic construct
  misc_feature 1..18: note = derived and/or modified sequence opt1 from anti-influenza_CDR
  source 1..18: mol_type = other RNA
cagggcatcagctcctac

SEQ ID NO: 14227 - RNA, 18 nt, synthetic construct
  misc_feature 1..18: note = derived and/or modified sequence opt1 from anti-influenza_CDR
  source 1..18: mol_type = other RNA
caggacgtgagcacctgg

SEQ ID NO: 14228 - RNA, 18 nt, synthetic construct
  misc_feature 1..18: note = derived and/or modified sequence opt1 from anti-influenza_CDR
  source 1..18: mol_type = other RNA
caggacatctacatctac

SEQ ID NO: 14229 - RNA, 18 nt, synthetic construct
  misc_feature 1..18: note = derived and/or modified sequence opt1 from anti-influenza_CDR
  source 1..18: mol_type = other RNA
gagaacatctggaacaac

SEQ ID NO: 14230 - RNA, 18 nt, synthetic construct
  misc_feature 1..18: note = derived and/or modified sequence opt1 from anti-influenza_CDR
  source 1..18: mol_type = other RNA
ggcttcaccgtgaccagc

SEQ ID NO: 14231 - RNA, 18 nt, synthetic construct
  misc_feature 1..18: note = derived and/or modified sequence opt1 from anti-influenza_CDR
  source 1..18: mol_type = other RNA
caggacatcagcggccac

SEQ ID NO: 14232 - RNA, 18 nt, synthetic construct
  misc_feature 1..18: note = derived and/or modified sequence opt1 from anti-influenza_CDR
  source 1..18: mol_type = other RNA
agcctgctcaccgaggtg

SEQ ID NO: 14233 - RNA, 18 nt, synthetic construct
  misc_feature 1..18: note = derived and/or modified sequence opt1 from anti-influenza_CDR
  source 1..18: mol_type = other RNA
ggcagctccatcagcaac

SEQ ID NO: 14234 - RNA, 18 nt, synthetic construct
  misc_feature 1..18: note = derived and/or modified sequence opt1 from anti-influenza_CDR
  source 1..18: mol_type = other RNA
ggcgggagcatcacctcc

SEQ ID NO: 14235 - RNA, 18 nt, synthetic construct
  misc_feature 1..18: note = derived and/or modified sequence opt1 from anti-influenza_CDR
  source 1..18: mol_type = other RNA
ggcgggagcatctccagc

SEQ ID NO: 14236 - RNA, 18 nt, synthetic construct
  misc_feature 1..18: note = derived and/or modified sequence opt1 from anti-influenza_CDR
  source 1..18: mol_type = other RNA
ggcctgagcgtgtccagc

SEQ ID NO: 14237 - RNA, 18 nt, synthetic construct
  misc_feature 1..18: note = derived and/or modified sequence opt1 from anti-influenza_CDR
  source 1..18: mol_type = other RNA
ggcgccagcatctccagc

SEQ ID NO: 14238 - RNA, 18 nt, synthetic construct
  misc_feature 1..18: note = derived and/or modified sequence opt1 from anti-influenza_CDR
  source 1..18: mol_type = other RNA
ggcgacagcatctccagc

SEQ ID NO: 14239 - RNA, 18 nt, synthetic construct
  misc_feature 1..18: note = derived and/or modified sequence opt1 from anti-influenza_CDR
  source 1..18: mol_type = other RNA
ggcgggagcatctccaac

SEQ ID NO: 14240 - RNA, 18 nt, synthetic construct
  misc_feature 1..18: note = derived and/or modified sequence opt1 from anti-influenza_CDR
  source 1..18: mol_type = other RNA
ggcgggagcatctccgcc

SEQ ID NO: 14241 - RNA, 18 nt, synthetic construct
  misc_feature 1..18: note = derived and/or modified sequence opt1 from anti-influenza_CDR
  source 1..18: mol_type = other RNA
ggcttcagcgtgtccgac

SEQ ID NO: 14242 - RNA, 18 nt, synthetic construct
  misc_feature 1..18: note = derived and/or modified sequence opt1 from anti-influenza_CDR
  source 1..18: mol_type = other RNA
agccgctccctggacgtg

SEQ ID NO: 14243 - RNA, 18 nt, synthetic construct
  misc_feature 1..18: note = derived and/or modified sequence opt1 from anti-influenza_CDR
  source 1..18: mol_type = other RNA
cgcagccagcagaccgtg

SEQ ID NO: 14244 - RNA, 18 nt, synthetic construct
  misc_feature 1..18: note = derived and/or modified sequence opt1 from anti-influenza_CDR
  source 1..18: mol_type = other RNA
cagaccatcaacaactac

SEQ ID NO: 14245 - RNA, 18 nt, synthetic construct
  misc_feature 1..18: note = derived and/or modified sequence opt1 from anti-influenza_CDR
  source 1..18: mol_type = other RNA
aacatgggccccaccagc

SEQ ID NO: 14246 - RNA, 18 nt, synthetic construct
  misc_feature 1..18: note = derived and/or modified sequence opt1 from anti-influenza_CDR
  source 1..18: mol_type = other RNA
caggtggtcggcaccaac

SEQ ID NO: 14247 - RNA, 18 nt, synthetic construct
  misc_feature 1..18: note = derived and/or modified sequence opt1 from anti-influenza_CDR
  source 1..18: mol_type = other RNA
cagggcatcaacacccac

SEQ ID NO: 14248 - RNA, 18 nt, synthetic construct
  misc_feature 1..18: note = derived and/or modified sequence opt1 from anti-influenza_CDR
  source 1..18: mol_type = other RNA
caggacatccgcaaccgg

SEQ ID NO: 14249 - RNA, 18 nt, synthetic construct
  misc_feature 1..18: note = derived and/or modified sequence opt1 from anti-influenza_CDR
  source 1..18: mol_type = other RNA
cagggcatcgggagcaac

SEQ ID NO: 14250 - RNA, 18 nt, synthetic construct
  misc_feature 1..18: note = derived and/or modified sequence opt1 from anti-influenza_CDR
  source 1..18: mol_type = other RNA
cagaccatctaccgctgg

SEQ ID NO: 14251 - RNA, 18 nt, synthetic construct
  misc_feature 1..18: note = derived and/or modified sequence opt1 from anti-influenza_CDR
  source 1..18: mol_type = other RNA
cagaccatcacccgcttc

SEQ ID NO: 14252 - RNA, 18 nt, synthetic construct
  misc_feature 1..18: note = derived and/or modified sequence opt1 from anti-influenza_CDR
  source 1..18: mol_type = other RNA
cgcctgggcgagaagttc

SEQ ID NO: 14253 - RNA, 18 nt, synthetic construct
  misc_feature 1..18: note = derived and/or modified sequence opt1 from anti-influenza_CDR
  source 1..18: mol_type = other RNA
aagctgggcgacaagttc

SEQ ID NO: 14254 - RNA, 18 nt, synthetic construct
  misc_feature 1..18: note = derived and/or modified sequence opt1 from anti-influenza_CDR
  source 1..18: mol_type = other RNA
cagggcctggggagcaac

SEQ ID NO: 14255 - RNA, 18 nt, synthetic construct
  misc_feature 1..18: note = derived and/or modified sequence opt1 from anti-influenza_CDR
  source 1..18: mol_type = other RNA
tacatcggcagcaagtcc

SEQ ID NO: 14256 - RNA, 18 nt, synthetic construct
  misc_feature 1..18: note = derived and/or modified sequence opt1 from anti-influenza_CDR
  source 1..18: mol_type = other RNA
cagctgatcagctcctac

SEQ ID NO: 14257 - RNA, 18 nt, synthetic construct
  misc_feature 1..18: note = derived and/or modified sequence opt1 from anti-influenza_CDR
  source 1..18: mol_type = other RNA
cagagcgtgtccagcaac

SEQ ID NO: 14258 - RNA, 18 nt, synthetic construct
  misc_feature 1..18: note = derived and/or modified sequence opt1 from anti-influenza_CDR
  source 1..18: mol_type = other RNA
caggtgatcagctcctac

SEQ ID NO: 14259 - RNA, 18 nt, synthetic construct
  misc_feature 1..18: note = derived and/or modified sequence opt1 from anti-influenza_CDR
  source 1..18: mol_type = other RNA
cagagcgtgaaccgcaac

SEQ ID NO: 14260 - RNA, 18 nt, synthetic construct
  misc_feature 1..18: note = derived and/or modified sequence opt1 from anti-influenza_CDR
  source 1..18: mol_type = other RNA
gacatcggcagcaagtcc

SEQ ID NO: 14261 - RNA, 18 nt, synthetic construct
  misc_feature 1..18: note = derived and/or modified sequence opt1 from anti-influenza_CDR
  source 1..18: mol_type = other RNA
cagagcgtgtccaccaac

SEQ ID NO: 14262 - RNA, 18 nt, synthetic construct
  misc_feature 1..18: note = derived and/or modified sequence opt1 from anti-influenza_CDR
  source 1..18: mol_type = other RNA
atgatcgccggctggcac

SEQ ID NO: 14263 - RNA, 18 nt, synthetic construct
  misc_feature 1..18: note = derived and/or modified sequence opt1 from anti-influenza_CDR
  source 1..18: mol_type = other RNA
caggacatcagcacctgg

SEQ ID NO: 14264 - RNA, 18 nt, synthetic construct
  misc_feature 1..18: note = derived and/or modified sequence opt1 from anti-influenza_CDR
  source 1..18: mol_type = other RNA
gagaagatctacagcaac

SEQ ID NO: 14265 - RNA, 21 nt, synthetic construct
  misc_feature 1..21: note = derived and/or modified sequence opt1 from anti-influenza_CDR
  source 1..21: mol_type = other RNA
atctactacaactacaacatc

SEQ ID NO: 14266 - RNA, 21 nt, synthetic construct
  misc_feature 1..21: note = derived and/or modified sequence opt1 from anti-influenza_CDR
  source 1..21: mol_type = other RNA
cagagcatctccagcggctac

SEQ ID NO: 14267 - RNA, 21 nt, synthetic construct
  misc_feature 1..21: note = derived and/or modified sequence opt1 from anti-influenza_CDR
  source 1..21: mol_type = other RNA
cagagcgtgtccagctcctac

SEQ ID NO: 14268 - RNA, 21 nt, synthetic construct
  misc_feature 1..21: note = derived and/or modified sequence opt1 from anti-influenza_CDR
  source 1..21: mol_type = other RNA
cagaccgtgagctccagctac

SEQ ID NO: 14269 - RNA, 21 nt, synthetic construct
  misc_feature 1..21: note = derived and/or modified sequence opt1 from anti-influenza_CDR
  source 1..21: mol_type = other RNA
agcaacaacgccgtgtggaac

SEQ ID NO: 14270 - RNA, 21 nt, synthetic construct
  misc_feature 1..21: note = derived and/or modified sequence opt1 from anti-influenza_CDR
  source 1..21: mol_type = other RNA
agcaactccgccgtgtggaac

SEQ ID NO: 14271 - RNA, 21 nt, synthetic construct
  misc_feature 1..21: note = derived and/or modified sequence opt1 from anti-influenza_CDR
  source 1..21: mol_type = other RNA
gccgccaccaccctgcagagc

SEQ ID NO: 14272 - RNA, 21 nt, synthetic construct
  misc_feature 1..21: note = derived and/or modified sequence opt1 from anti-influenza_CDR
  source 1..21: mol_type = other RNA
agcaaccgcgccacctggaac

SEQ ID NO: 14273 - RNA, 21 nt, synthetic construct
  misc_feature 1..21: note = derived and/or modified sequence opt1 from anti-influenza_CDR
  source 1..21: mol_type = other RNA
gccaccagcaccctgcagtcc

SEQ ID NO: 14274 - RNA, 21 nt, synthetic construct
  misc_feature 1..21: note = derived and/or modified sequence opt1 from anti-influenza_CDR
  source 1..21: mol_type = other RNA
agcaactccgccacctggaac

SEQ ID NO: 14275 - RNA, 21 nt, synthetic construct
  misc_feature 1..21: note = derived and/or modified sequence opt1 from anti-influenza_CDR
  source 1..21: mol_type = other RNA
gccagctccaccctgcagagc

SEQ ID NO: 14276 - RNA, 21 nt, synthetic construct
  misc_feature 1..21: note = derived and/or modified sequence opt1 from anti-influenza_CDR
  source 1..21: mol_type = other RNA
agctacaacgccgtgtggaac

SEQ ID NO: 14277 - RNA, 21 nt, synthetic construct
  misc_feature 1..21: note = derived and/or modified sequence opt1 from anti-influenza_CDR
  source 1..21: mol_type = other RNA
gccgccagctcccgcctgagc

SEQ ID NO: 14278 - RNA, 21 nt, synthetic construct
  misc_feature 1..21: note = derived and/or modified sequence opt1 from anti-influenza_CDR
  source 1..21: mol_type = other RNA
gccgccagctcccgcggcagc

SEQ ID NO: 14279 - RNA, 21 nt, synthetic construct
  misc_feature 1..21: note = derived and/or modified sequence opt1 from anti-influenza_CDR
  source 1..21: mol_type = other RNA
atctaccacagcggctccgcc

SEQ ID NO: 14280 - RNA, 21 nt, synthetic construct
  misc_feature 1..21: note = derived and/or modified sequence opt1 from anti-influenza_CDR
  source 1..21: mol_type = other RNA
atctactacagcggcgtgacc

SEQ ID NO: 14281 - RNA, 21 nt, synthetic construct
  misc_feature 1..21: note = derived and/or modified sequence opt1 from anti-influenza_CDR
  source 1..21: mol_type = other RNA
agctcctacctggcctggtac

SEQ ID NO: 14282 - RNA, 21 nt, synthetic construct
  misc_feature 1..21: note = derived and/or modified sequence opt1 from anti-influenza_CDR
  source 1..21: mol_type = other RNA
cagagcctgtccagctccagc

SEQ ID NO: 14283 - RNA, 21 nt, synthetic construct
  misc_feature 1..21: note = derived and/or modified sequence opt1 from anti-influenza_CDR
  source 1..21: mol_type = other RNA
cagagcgtgtccatcagctac

SEQ ID NO: 14284 - RNA, 21 nt, synthetic construct
  misc_feature 1..21: note = derived and/or modified sequence opt1 from anti-influenza_CDR
  source 1..21: mol_type = other RNA
gacgtgaccgagcgccccagc

SEQ ID NO: 14285 - RNA, 21 nt, synthetic construct
  misc_feature 1..21: note = derived and/or modified sequence opt1 from anti-influenza_CDR
  source 1..21: mol_type = other RNA
gccgccagcaccctgctcgac

SEQ ID NO: 14286 - RNA, 21 nt, synthetic construct
  misc_feature 1..21: note = derived and/or modified sequence opt1 from anti-influenza_CDR
  source 1..21: mol_type = other RNA
gccgccagcaccctgcactcc

SEQ ID NO: 14287 - RNA, 21 nt, synthetic construct
  misc_feature 1..21: note = derived and/or modified sequence opt1 from anti-influenza_CDR
  source 1..21: mol_type = other RNA
ggcgccagctccctgcagggg

SEQ ID NO: 14288 - RNA, 21 nt, synthetic construct
  misc_feature 1..21: note = derived and/or modified sequence opt1 from anti-influenza_CDR
  source 1..21: mol_type = other RNA
accaacggcgtgaacgtcggg

SEQ ID NO: 14289 - RNA, 21 nt, synthetic construct
  misc_feature 1..21: note = derived and/or modified sequence opt1 from anti-influenza_CDR
  source 1..21: mol_type = other RNA
gacgccagcacccgcgccacc

SEQ ID NO: 14290 - RNA, 21 nt, synthetic construct
  misc_feature 1..21: note = derived and/or modified sequence opt1 from anti-influenza_CDR
  source 1..21: mol_type = other RNA
agcgagacctactactggtcc

SEQ ID NO: 14291 - RNA, 21 nt, synthetic construct
  misc_feature 1..21: note = derived and/or modified sequence opt1 from anti-influenza_CDR
  source 1..21: mol_type = other RNA
gaggccgtgaacctggagagc

SEQ ID NO: 14292 - RNA, 21 nt, synthetic construct
  misc_feature 1..21: note = derived and/or modified sequence opt1 from anti-influenza_CDR
  source 1..21: mol_type = other RNA
ggcgccagcacccgcgccacc

SEQ ID NO: 14293 - RNA, 21 nt, synthetic construct
  misc_feature 1..21: note = derived and/or modified sequence opt1 from anti-influenza_CDR
  source 1..21: mol_type = other RNA
gtgagcggctactactggtcc

SEQ ID NO: 14294 - RNA, 21 nt, synthetic construct
  misc_feature 1..21: note = derived and/or modified sequence opt1 from anti-influenza_CDR
  source 1..21: mol_type = other RNA
atcaccggcgtgcgcgtcggg

SEQ ID NO: 14295 - RNA, 21 nt, synthetic construct
  misc_feature 1..21: note = derived and/or modified sequence opt1 from anti-influenza_CDR
  source 1..21: mol_type = other RNA
gacgccagcaaccgcgccacc

SEQ ID NO: 14296 - RNA, 21 nt, synthetic construct
  misc_feature 1..21: note = derived and/or modified sequence opt1 from anti-influenza_CDR
  source 1..21: mol_type = other RNA
gaggtgaccaactggcccagc

SEQ ID NO: 14297 - RNA, 21 nt, synthetic construct
  misc_feature 1..21: note = derived and/or modified sequence opt1 from anti-influenza_CDR
  source 1..21: mol_type = other RNA
aaggacagcgagcgcccctcc

SEQ ID NO: 14298 - RNA, 21 nt, synthetic construct
  misc_feature 1..21: note = derived and/or modified sequence opt1 from anti-influenza_CDR
  source 1..21: mol_type = other RNA
agcggcaactactactggaac

SEQ ID NO: 14299 - RNA, 21 nt, synthetic construct
  misc_feature 1..21: note = derived and/or modified sequence opt1 from anti-influenza_CDR
  source 1..21: mol_type = other RNA
agcaccaccatccgccactcc

SEQ ID NO: 14300 - RNA, 21 nt, synthetic construct
  misc_feature 1..21: note = derived and/or modified sequence opt1 from anti-influenza_CDR
  source 1..21: mol_type = other RNA
gacgacagcggccgcccctcc

SEQ ID NO: 14301 - RNA, 21 nt, synthetic construct
  misc_feature 1..21: note = derived and/or modified sequence opt1 from anti-influenza_CDR
  source 1..21: mol_type = other RNA
cgcaacgacctgcggcccagc

SEQ ID NO: 14302 - RNA, 21 nt, synthetic construct
  misc_feature 1..21: note = derived and/or modified sequence opt1 from anti-influenza_CDR
  source 1..21: mol_type = other RNA
agcgtggaccactactggtcc

SEQ ID NO: 14303 - RNA, 21 nt, synthetic construct
  misc_feature 1..21: note = derived and/or modified sequence opt1 from anti-influenza_CDR
  source 1..21: mol_type = other RNA
gccgtgagcatcctgcagtcc

SEQ ID NO: 14304 - RNA, 21 nt, synthetic construct
  misc_feature 1..21: note = derived and/or modified sequence opt1 from anti-influenza_CDR
  source 1..21: mol_type = other RNA
gacgacaccgaccgccccagc

SEQ ID NO: 14305 - RNA, 21 nt, synthetic construct
  misc_feature 1..21: note = derived and/or modified sequence opt1 from anti-influenza_CDR
  source 1..21: mol_type = other RNA
gagaacaacaagcgccccagc

SEQ ID NO: 14306 - RNA, 21 nt, synthetic construct
  misc_feature 1..21: note = derived and/or modified sequence opt1 from anti-influenza_CDR
  source 1..21: mol_type = other RNA
gacagctccaaccgcgccccc

SEQ ID NO: 14307 - RNA, 21 nt, synthetic construct
  misc_feature 1..21: note = derived and/or modified sequence opt1 from anti-influenza_CDR
  source 1..21: mol_type = other RNA
gaggtgaccaagcgccccagc

SEQ ID NO: 14308 - RNA, 21 nt, synthetic construct
  misc_feature 1..21: note = derived and/or modified sequence opt1 from anti-influenza_CDR
  source 1..21: mol_type = other RNA
gccaccagcaacacccactcc

SEQ ID NO: 14309 - RNA, 21 nt, synthetic construct
  misc_feature 1..21: note = derived and/or modified sequence opt1 from anti-influenza_CDR
  source 1..21: mol_type = other RNA
gccgccagcaacctggagaac

SEQ ID NO: 14310 - RNA, 21 nt, synthetic construct
  misc_feature 1..21: note = derived and/or modified sequence opt1 from anti-influenza_CDR
  source 1..21: mol_type = other RNA
gccgccagcggcctgcagtcc

SEQ ID NO: 14311 - RNA, 21 nt, synthetic construct
  misc_feature 1..21: note = derived and/or modified sequence opt1 from anti-influenza_CDR
  source 1..21: mol_type = other RNA
ggcttcaccgtgagctccaac

SEQ ID NO: 14312 - RNA, 21 nt, synthetic construct
  misc_feature 1..21: note = derived and/or modified sequence opt1 from anti-influenza_CDR
  source 1..21: mol_type = other RNA
ggcgggggctacagctggaac

SEQ ID NO: 14313 - RNA, 21 nt, synthetic construct
  misc_feature 1..21: note = derived and/or modified sequence opt1 from anti-influenza_CDR
  source 1..21: mol_type = other RNA
ggcgccagcaacctgcagtcc

SEQ ID NO: 14314 - RNA, 21 nt, synthetic construct
  misc_feature 1..21: note = derived and/or modified sequence opt1 from anti-influenza_CDR
  source 1..21: mol_type = other RNA
ggcgccaccaacctgcagagc

SEQ ID NO: 14315 - RNA, 21 nt, synthetic construct
  misc_feature 1..21: note = derived and/or modified sequence opt1 from anti-influenza_CDR
  source 1..21: mol_type = other RNA
ggcgccagcaacctgcactcc

SEQ ID NO: 14316 - RNA, 21 nt, synthetic construct
  misc_feature 1..21: note = derived and/or modified sequence opt1 from anti-influenza_CDR
  source 1..21: mol_type = other RNA
ggcgccagcaccctgcagtcc

SEQ ID NO: 14317 - RNA, 21 nt, synthetic construct
  misc_feature 1..21: note = derived and/or modified sequence opt1 from anti-influenza_CDR
  source 1..21: mol_type = other RNA
gacaacagcgaccgcccctcc

SEQ ID NO: 14318 - RNA, 21 nt, synthetic construct
  misc_feature 1..21: note = derived and/or modified sequence opt1 from anti-influenza_CDR
  source 1..21: mol_type = other RNA
ggcgccagctccctgcagagc

SEQ ID NO: 14319 - RNA, 21 nt, synthetic construct
  misc_feature 1..21: note = derived and/or modified sequence opt1 from anti-influenza_CDR
  source 1..21: mol_type = other RNA
ggcaacagcaaccgcccctcc

SEQ ID NO: 14320 - RNA, 21 nt, synthetic construct
  misc_feature 1..21: note = derived and/or modified sequence opt1 from anti-influenza_CDR
  source 1..21: mol_type = other RNA
gccgccagctccctgcagagc

SEQ ID NO: 14321 - RNA, 21 nt, synthetic construct
  misc_feature 1..21: note = derived and/or modified sequence opt1 from anti-influenza_CDR
  source 1..21: mol_type = other RNA
gccgccagctccctgcacagc

SEQ ID NO: 14322 - RNA, 21 nt, synthetic construct
  misc_feature 1..21: note = derived and/or modified sequence opt1 from anti-influenza_CDR
  source 1..21: mol_type = other RNA
ggcgccagcaccctgcagaac

SEQ ID NO: 14323 - RNA, 21 nt, synthetic construct
  misc_feature 1..21: note = derived and/or modified sequence opt1 from anti-influenza_CDR
  source 1..21: mol_type = other RNA
ggcgccaccgacctgcagagc

SEQ ID NO: 14324 - RNA, 21 nt, synthetic construct
  misc_feature 1..21: note = derived and/or modified sequence opt1 from anti-influenza_CDR
  source 1..21: mol_type = other RNA
agcggcgcctactactggacc

SEQ ID NO: 14325 - RNA, 21 nt, synthetic construct
  misc_feature 1..21: note = derived and/or modified sequence opt1 from anti-influenza_CDR
  source 1..21: mol_type = other RNA
gtgagcgacaactacatcaac

SEQ ID NO: 14326 - RNA, 21 nt, synthetic construct
  misc_feature 1..21: note = derived and/or modified sequence opt1 from anti-influenza_CDR
  source 1..21: mol_type = other RNA
tgggccagcacccgcgagtcc

SEQ ID NO: 14327 - RNA, 21 nt, synthetic construct
  misc_feature 1..21: note = derived and/or modified sequence opt1 from anti-influenza_CDR
  source 1..21: mol_type = other RNA
agcaacaaccagcgcccctcc

SEQ ID NO: 14328 - RNA, 21 nt, synthetic construct
  misc_feature 1..21: note = derived and/or modified sequence opt1 from anti-influenza_CDR
  source 1..21: mol_type = other RNA
gaggtgagcaaccgcccctcc

SEQ ID NO: 14329 - RNA, 21 nt, synthetic construct
  misc_feature 1..21: note = derived and/or modified sequence opt1 from anti-influenza_CDR
  source 1..21: mol_type = other RNA
aagaacacccagcgccccagc

SEQ ID NO: 14330 - RNA, 21 nt, synthetic construct
  misc_feature 1..21: note = derived and/or modified sequence opt1 from anti-influenza_CDR
  source 1..21: mol_type = other RNA
gacaacaacaagcgccccagc

SEQ ID NO: 14331 - RNA, 21 nt, synthetic construct
  misc_feature 1..21: note = derived and/or modified sequence opt1 from anti-influenza_CDR
  source 1..21: mol_type = other RNA
gacgccagcaccctgcgctcc

SEQ ID NO: 14332 - RNA, 21 nt, synthetic construct
  misc_feature 1..21: note = derived and/or modified sequence opt1 from anti-influenza_CDR
  source 1..21: mol_type = other RNA
caggacaaccgccggcccagc

SEQ ID NO: 14333 - RNA, 21 nt, synthetic construct
  misc_feature 1..21: note = derived and/or modified sequence opt1 from anti-influenza_CDR
  source 1..21: mol_type = other RNA
gacgtgagcaagcgcccctcc

SEQ ID NO: 14334 - RNA, 21 nt, synthetic construct
  misc_feature 1..21: note = derived and/or modified sequence opt1 from anti-influenza_CDR
  source 1..21: mol_type = other RNA
gacgccagctcccgcgccacc

SEQ ID NO: 14335 - RNA, 21 nt, synthetic construct
  misc_feature 1..21: note = derived and/or modified sequence opt1 from anti-influenza_CDR
  source 1..21: mol_type = other RNA
ctgggcagcaaccgcgcctcc

SEQ ID NO: 14336 - RNA, 21 nt, synthetic construct
  misc_feature 1..21: note = derived and/or modified sequence opt1 from anti-influenza_CDR
  source 1..21: mol_type = other RNA
ggcgccagcacccgcgccgcg

SEQ ID NO: 14337 - RNA, 21 nt, synthetic construct
  misc_feature 1..21: note = derived and/or modified sequence opt1 from anti-influenza_CDR
  source 1..21: mol_type = other RNA
gacgacagcgaccgcccctcc

SEQ ID NO: 14338 - RNA, 21 nt, synthetic construct
  misc_feature 1..21: note = derived and/or modified sequence opt1 from anti-influenza_CDR
  source 1..21: mol_type = other RNA
cgcgacggccagcggcccagc

SEQ ID NO: 14339 - RNA, 21 nt, synthetic construct
  misc_feature 1..21: note = derived and/or modified sequence opt1 from anti-influenza_CDR
  source 1..21: mol_type = other RNA
ggcgccagctcccgcgccacc

SEQ ID NO: 14340 - RNA, 21 nt, synthetic construct
  misc_feature 1..21: note = derived and/or modified sequence opt1 from anti-influenza_CDR
  source 1..21: mol_type = other RNA
ggcgccagctcccgcgccagc

SEQ ID NO: 14341 - RNA, 21 nt, synthetic construct
  misc_feature 1..21: note = derived and/or modified sequence opt1 from anti-influenza_CDR
  source 1..21: mol_type = other RNA
gccgccagcaccctgcagtcc

SEQ ID NO: 14342 - RNA, 21 nt, synthetic construct
  misc_feature 1..21: note = derived and/or modified sequence opt1 from anti-influenza_CDR
  source 1..21: mol_type = other RNA
ctggtgagcaagcgcgcctcc

SEQ ID NO: 14343 - RNA, 21 nt, synthetic construct
  misc_feature 1..21: note = derived and/or modified sequence opt1 from anti-influenza_CDR
  source 1..21: mol_type = other RNA
gacgtgacctaccgccccagc

SEQ ID NO: 14344 - RNA, 21 nt, synthetic construct
  misc_feature 1..21: note = derived and/or modified sequence opt1 from anti-influenza_CDR
  source 1..21: mol_type = other RNA
atgcaggccctggagaccccc

SEQ ID NO: 14345 - RNA, 21 nt, synthetic construct
  misc_feature 1..21: note = derived and/or modified sequence opt1 from anti-influenza_CDR
  source 1..21: mol_type = other RNA
cagaactacggcagccccttc

SEQ ID NO: 14346 - RNA, 21 nt, synthetic construct
  misc_feature 1..21: note = derived and/or modified sequence opt1 from anti-influenza_CDR
  source 1..21: mol_type = other RNA
cagcagtacggcagcctgccc

SEQ ID NO: 14347 - RNA, 21 nt, synthetic construct
  misc_feature 1..21: note = derived and/or modified sequence opt1 from anti-influenza_CDR
  source 1..21: mol_type = other RNA
tggggcagctacctggagtcc

SEQ ID NO: 14348 - RNA, 21 nt, synthetic construct
  misc_feature 1..21: note = derived and/or modified sequence opt1 from anti-influenza_CDR
  source 1..21: mol_type = other RNA
agcgcctccacccgcgccacc

SEQ ID NO: 14349 - RNA, 21 nt, synthetic construct
  misc_feature 1..21: note = derived and/or modified sequence opt1 from anti-influenza_CDR
  source 1..21: mol_type = other RNA
ggcgccagcacccgcgcctcc

SEQ ID NO: 14350 - RNA, 21 nt, synthetic construct
  misc_feature 1..21: note = derived and/or modified sequence opt1 from anti-influenza_CDR
  source 1..21: mol_type = other RNA
ggcgccagcacccgcgacacc

SEQ ID NO: 14351 - RNA, 21 nt, synthetic construct
  misc_feature 1..21: note = derived and/or modified sequence opt1 from anti-influenza_CDR
  source 1..21: mol_type = other RNA
aaggtgagcaccctggagtcc

SEQ ID NO: 14352 - RNA, 21 nt, synthetic construct
  misc_feature 1..21: note = derived and/or modified sequence opt1 from anti-influenza_CDR
  source 1..21: mol_type = other RNA
agcaacaccgagcgcccctcc

SEQ ID NO: 14353 - RNA, 21 nt, synthetic construct
  misc_feature 1..21: note = derived and/or modified sequence opt1 from anti-influenza_CDR
  source 1..21: mol_type = other RNA
aagatcagcaaccgcgactcc

SEQ ID NO: 14354 - RNA, 21 nt, synthetic construct
  misc_feature 1..21: note = derived and/or modified sequence opt1 from anti-influenza_CDR
  source 1..21: mol_type = other RNA
agcgcctcccaccgctacagc

SEQ ID NO: 14355 - RNA, 21 nt, synthetic construct
  misc_feature 1..21: note = derived and/or modified sequence opt1 from anti-influenza_CDR
  source 1..21: mol_type = other RNA
cagagcgtgcgctccaacaac

SEQ ID NO: 14356 - RNA, 21 nt, synthetic construct
  misc_feature 1..21: note = derived and/or modified sequence opt1 from anti-influenza_CDR
  source 1..21: mol_type = other RNA
cagagcgtgcgctccggctac

SEQ ID NO: 14357 - RNA, 21 nt, synthetic construct
  misc_feature 1..21: note = derived and/or modified sequence opt1 from anti-influenza_CDR
  source 1..21: mol_type = other RNA
atctactaccgcggcagcacc

SEQ ID NO: 14358 - RNA, 21 nt, synthetic construct
  misc_feature 1..21: note = derived and/or modified sequence opt1 from anti-influenza_CDR
  source 1..21: mol_type = other RNA
gtgtactacagcggcatcacc

SEQ ID NO: 14359 - RNA, 21 nt, synthetic construct
  misc_feature 1..21: note = derived and/or modified sequence opt1 from anti-influenza_CDR
  source 1..21: mol_type = other RNA
agccacttcgccaacctgaag

SEQ ID NO: 14360 - RNA, 21 nt, synthetic construct
  misc_feature 1..21: note = derived and/or modified sequence opt1 from anti-influenza_CDR
  source 1..21: mol_type = other RNA
ctgaacaagagcaagccctac

SEQ ID NO: 14361 - RNA, 21 nt, synthetic construct
  misc_feature 1..21: note = derived and/or modified sequence opt1 from anti-influenza_CDR
  source 1..21: mol_type = other RNA
aagctggccaacaccggcacc

SEQ ID NO: 14362 - RNA, 21 nt, synthetic construct
  misc_feature 1..21: note = derived and/or modified sequence opt1 from anti-influenza_CDR
  source 1..21: mol_type = other RNA
gccgccagcaccctgacctcc

SEQ ID NO: 14363 - RNA, 21 nt, synthetic construct
  misc_feature 1..21: note = derived and/or modified sequence opt1 from anti-influenza_CDR
  source 1..21: mol_type = other RNA
gacgccagcaagctggcctcc

SEQ ID NO: 14364 - RNA, 21 nt, synthetic construct
  misc_feature 1..21: note = derived and/or modified sequence opt1 from anti-influenza_CDR
  source 1..21: mol_type = other RNA
ttcgccagccgcctggcctcc

SEQ ID NO: 14365 - RNA, 21 nt, synthetic construct
  misc_feature 1..21: note = derived and/or modified sequence opt1 from anti-influenza_CDR
  source 1..21: mol_type = other RNA
agcgcctccaccctggccagc

SEQ ID NO: 14366 - RNA, 21 nt, synthetic construct
  misc_feature 1..21: note = derived and/or modified sequence opt1 from anti-influenza_CDR
  source 1..21: mol_type = other RNA
gaggtgagccagcgcccctcc

SEQ ID NO: 14367 - RNA, 21 nt, synthetic construct
  misc_feature 1..21: note = derived and/or modified sequence opt1 from anti-influenza_CDR
  source 1..21: mol_type = other RNA
ggcgggaccctgaacaactac

SEQ ID NO: 14368 - RNA, 21 nt, synthetic construct
  misc_feature 1..21: note = derived and/or modified sequence opt1 from anti-influenza_CDR
  source 1..21: mol_type = other RNA
gacatcgtgatgacccagagc

SEQ ID NO: 14369 - RNA, 24 nt, synthetic construct
  misc_feature 1..24: note = derived and/or modified sequence opt1 from anti-influenza_CDR
  source 1..24: mol_type = other RNA
ggcttcaccttcagcaactacgcc

SEQ ID NO: 14370 - RNA, 24 nt, synthetic construct
  misc_feature 1..24: note = derived and/or modified sequence opt1 from anti-influenza_CDR
  source 1..24: mol_type = other RNA
ggcttcaccttcagcaactacggg

SEQ ID NO: 14371 - RNA, 24 nt, synthetic construct
  misc_feature 1..24: note = derived and/or modified sequence opt1 from anti-influenza_CDR
  source 1..24: mol_type = other RNA
ggcttcaccttcagctcctacgcc

SEQ ID NO: 14372 - RNA, 24 nt, synthetic construct
  misc_feature 1..24: note = derived and/or modified sequence opt1 from anti-influenza_CDR
  source 1..24: mol_type = other RNA
ggcttcaccttcagcacctacgcc

SEQ ID NO: 14373 - RNA, 24 nt, synthetic construct
  misc_feature 1..24: note = derived and/or modified sequence opt1 from anti-influenza_CDR
  source 1..24: mol_type = other RNA
ggcgggatcttcatcagccaggcc

SEQ ID NO: 14374 - RNA, 24 nt, synthetic construct
  misc_feature 1..24: note = derived and/or modified sequence opt1 from anti-influenza_CDR
  source 1..24: mol_type = other RNA
ggcgggatcttcagcccctacgcc

SEQ ID NO: 14375 - RNA, 24 nt, synthetic construct
  misc_feature 1..24: note = derived and/or modified sequence opt1 from anti-influenza_CDR
  source 1..24: mol_type = other RNA
ggcgggcccttcagcggcttcgcc

SEQ ID NO: 14376 - RNA, 24 nt, synthetic construct
  misc_feature 1..24: note = derived and/or modified sequence opt1 from anti-influenza_CDR
  source 1..24: mol_type = other RNA
ggcgggaccttcaacagccacgcc

SEQ ID NO: 14377 - RNA, 24 nt, synthetic construct
  misc_feature 1..24: note = derived and/or modified sequence opt1 from anti-influenza_CDR
  source 1..24: mol_type = other RNA
ggcagcaacatcgggtccaacacc

SEQ ID NO: 14378 - RNA, 24 nt, synthetic construct
  misc_feature 1..24: note = derived and/or modified sequence opt1 from anti-influenza_CDR
  source 1..24: mol_type = other RNA
ggcgtgaccttcagcatgtacgcc

SEQ ID NO: 14379 - RNA, 24 nt, synthetic construct
  misc_feature 1..24: note = derived and/or modified sequence opt1 from anti-influenza_CDR
  source 1..24: mol_type = other RNA
ggcgtgaccttcagcatgtacacc

SEQ ID NO: 14380 - RNA, 24 nt, synthetic construct
  misc_feature 1..24: note = derived and/or modified sequence opt1 from anti-influenza_CDR
  source 1..24: mol_type = other RNA
ggcgtgaccagctccaactacccc

SEQ ID NO: 14381 - RNA, 24 nt, synthetic construct
  misc_feature 1..24: note = derived and/or modified sequence opt1 from anti-influenza_CDR
  source 1..24: mol_type = other RNA
atcatcgccatcttcggcaccacc

SEQ ID NO: 14382 - RNA, 24 nt, synthetic construct
  misc_feature 1..24: note = derived and/or modified sequence opt1 from anti-influenza_CDR
  source 1..24: mol_type = other RNA
atcatccccctgttcggcaccgcc

SEQ ID NO: 14383 - RNA, 24 nt, synthetic construct
  misc_feature 1..24: note = derived and/or modified sequence opt1 from anti-influenza_CDR
  source 1..24: mol_type = other RNA
atcatccccctgttcggcaccacc

SEQ ID NO: 14384 - RNA, 24 nt, synthetic construct
  misc_feature 1..24: note = derived and/or modified sequence opt1 from anti-influenza_CDR
  source 1..24: mol_type = other RNA
atcatccccatgttcggcgccacc

SEQ ID NO: 14385 - RNA, 24 nt, synthetic construct
  misc_feature 1..24: note = derived and/or modified sequence opt1 from anti-influenza_CDR
  source 1..24: mol_type = other RNA
atcatccccatgttcggcaccacc

SEQ ID NO: 14386 - RNA, 24 nt, synthetic construct
  misc_feature 1..24: note = derived and/or modified sequence opt1 from anti-influenza_CDR
  source 1..24: mol_type = other RNA
atcaacagcggcgggggcgccacc

SEQ ID NO: 14387 - RNA, 24 nt, synthetic construct
  misc_feature 1..24: note = derived and/or modified sequence opt1 from anti-influenza_CDR
  source 1..24: mol_type = other RNA
atcagcgccgtgttcggcaccgcc

SEQ ID NO: 14388 - RNA, 24 nt, synthetic construct
  misc_feature 1..24: note = derived and/or modified sequence opt1 from anti-influenza_CDR
  source 1..24: mol_type = other RNA
atcagctacgacgccaactacaag

SEQ ID NO: 14389 - RNA, 24 nt, synthetic construct
  misc_feature 1..24: note = derived and/or modified sequence opt1 from anti-influenza_CDR
  source 1..24: mol_type = other RNA
atcagctacgacggcaactacaag

SEQ ID NO: 14390 - RNA, 24 nt, synthetic construct
  misc_feature 1..24: note = derived and/or modified sequence opt1 from anti-influenza_CDR
  source 1..24: mol_type = other RNA
atcagctacgacggctccaacaag

SEQ ID NO: 14391 - RNA, 24 nt, synthetic construct
  misc_feature 1..24: note = derived and/or modified sequence opt1 from anti-influenza_CDR
  source 1..24: mol_type = other RNA
atcagctacgacggctccaaccag

SEQ ID NO: 14392 - RNA, 24 nt, synthetic construct
  misc_feature 1..24: note = derived and/or modified sequence opt1 from anti-influenza_CDR
  source 1..24: mol_type = other RNA
cagcagtactaccgcagcccctcc

SEQ ID NO: 14393 - RNA, 24 nt, synthetic construct
  misc_feature 1..24: note = derived and/or modified sequence opt1 from anti-influenza_CDR
  source 1..24: mol_type = other RNA
gtgctgcccctcttcggcgtcacc

SEQ ID NO: 14394 - RNA, 24 nt, synthetic construct
  misc_feature 1..24: note = derived and/or modified sequence opt1 from anti-influenza_CDR
  source 1..24: mol_type = other RNA
ggcgggaccttcagctccgacgcc

SEQ ID NO: 14395 - RNA, 24 nt, synthetic construct
  misc_feature 1..24: note = derived and/or modified sequence opt1 from anti-influenza_CDR
  source 1..24: mol_type = other RNA
atcatccccgtgttccagaccgcc

SEQ ID NO: 14396 - RNA, 24 nt, synthetic construct
  misc_feature 1..24: note = derived and/or modified sequence opt1 from anti-influenza_CDR
  source 1..24: mol_type = other RNA
accagcaacatcggctccaacgcc

SEQ ID NO: 14397 - RNA, 24 nt, synthetic construct
  misc_feature 1..24: note = derived and/or modified sequence opt1 from anti-influenza_CDR
  source 1..24: mol_type = other RNA
ggctacagcttcacctcccgctgg

SEQ ID NO: 14398 - RNA, 24 nt, synthetic construct
  misc_feature 1..24: note = derived and/or modified sequence opt1 from anti-influenza_CDR
  source 1..24: mol_type = other RNA
atctaccccagcgactccgacgtg

SEQ ID NO: 14399 - RNA, 24 nt, synthetic construct
  misc_feature 1..24: note = derived and/or modified sequence opt1 from anti-influenza_CDR
  source 1..24: mol_type = other RNA
cagcagtacgacaactggctgagc

SEQ ID NO: 14400 - RNA, 24 nt, synthetic construct
  misc_feature 1..24: note = derived and/or modified sequence opt1 from anti-influenza_CDR
  source 1..24: mol_type = other RNA
ggcgggaccttcagcaactacggc

SEQ ID NO: 14401 - RNA, 24 nt, synthetic construct
  misc_feature 1..24: note = derived and/or modified sequence opt1 from anti-influenza_CDR
  source 1..24: mol_type = other RNA
ggcgccagcatctccagctcctac

SEQ ID NO: 14402 - RNA, 24 nt, synthetic construct
  misc_feature 1..24: note = derived and/or modified sequence opt1 from anti-influenza_CDR
  source 1..24: mol_type = other RNA
ggcgggaccttcagctcctacgac

SEQ ID NO: 14403 - RNA, 24 nt, synthetic construct
  misc_feature 1..24: note = derived and/or modified sequence opt1 from anti-influenza_CDR
  source 1..24: mol_type = other RNA
atcatccccatctacggcaccgcc

SEQ ID NO: 14404 - RNA, 24 nt, synthetic construct
  misc_feature 1..24: note = derived and/or modified sequence opt1 from anti-influenza_CDR
  source 1..24: mol_type = other RNA
ggctacaccagcaccacgtacggg

SEQ ID NO: 14405 - RNA, 24 nt, synthetic construct
  misc_feature 1..24: note = derived and/or modified sequence opt1 from anti-influenza_CDR
  source 1..24: mol_type = other RNA
atcaacccctacaacggcaacccg

SEQ ID NO: 14406 - RNA, 24 nt, synthetic construct
  misc_feature 1..24: note = derived and/or modified sequence opt1 from anti-influenza_CDR
  source 1..24: mol_type = other RNA
atctggtacgacggcgacaacaag

SEQ ID NO: 14407 - RNA, 24 nt, synthetic construct
  misc_feature 1..24: note = derived and/or modified sequence opt1 from anti-influenza_CDR
  source 1..24: mol_type = other RNA
ggcttcaccttcagcgacttctgg

SEQ ID NO: 14408 - RNA, 24 nt, synthetic construct
  misc_feature 1..24: note = derived and/or modified sequence opt1 from anti-influenza_CDR
  source 1..24: mol_type = other RNA
atcgaccaggacggcaacgagcgc

SEQ ID NO: 14409 - RNA, 24 nt, synthetic construct
  misc_feature 1..24: note = derived and/or modified sequence opt1 from anti-influenza_CDR
  source 1..24: mol_type = other RNA
agctccaacatcggcaagaactac

SEQ ID NO: 14410 - RNA, 24 nt, synthetic construct
  misc_feature 1..24: note = derived and/or modified sequence opt1 from anti-influenza_CDR
  source 1..24: mol_type = other RNA
ggctacaccttcaccaactactgg

SEQ ID NO: 14411 - RNA, 24 nt, synthetic construct
  misc_feature 1..24: note = derived and/or modified sequence opt1 from anti-influenza_CDR
  source 1..24: mol_type = other RNA
atcttcccgcccgacagccagacc

SEQ ID NO: 14412 - RNA, 24 nt, synthetic construct
  misc_feature 1..24: note = derived and/or modified sequence opt1 from anti-influenza_CDR
  source 1..24: mol_type = other RNA
ggctacagcttctccgactactgg

SEQ ID NO: 14413 - RNA, 24 nt, synthetic construct
  misc_feature 1..24: note = derived and/or modified sequence opt1 from anti-influenza_CDR
  source 1..24: mol_type = other RNA
atctaccccgccagctccgagatc

SEQ ID NO: 14414 - RNA, 24 nt, synthetic construct
  misc_feature 1..24: note = derived and/or modified sequence opt1 from anti-influenza_CDR
  source 1..24: mol_type = other RNA
agcggcgactccgggacctggaac

SEQ ID NO: 14415 - RNA, 24 nt, synthetic construct
  misc_feature 1..24: note = derived and/or modified sequence opt1 from anti-influenza_CDR
  source 1..24: mol_type = other RNA
ggcgggaccctgaacaactacgcc

SEQ ID NO: 14416 - RNA, 24 nt, synthetic construct
  misc_feature 1..24: note = derived and/or modified sequence opt1 from anti-influenza_CDR
  source 1..24: mol_type = other RNA
atcagccccatcttcggcaccctg

SEQ ID NO: 14417 - RNA, 24 nt, synthetic construct
  misc_feature 1..24: note = derived and/or modified sequence opt1 from anti-influenza_CDR
  source 1..24: mol_type = other RNA
ggcgtgttcttcagctcccacgcc

SEQ ID NO: 14418 - RNA, 24 nt, synthetic construct
  misc_feature 1..24: note = derived and/or modified sequence opt1 from anti-influenza_CDR
  source 1..24: mol_type = other RNA
atcagccccatgttcggcaccacc

SEQ ID NO: 14419 - RNA, 24 nt, synthetic construct
  misc_feature 1..24: note = derived and/or modified sequence opt1 from anti-influenza_CDR
  source 1..24: mol_type = other RNA
ggcttcaccttcagccgcttcggg

SEQ ID NO: 14420 - RNA, 24 nt, synthetic construct
  misc_feature 1..24: note = derived and/or modified sequence opt1 from anti-influenza_CDR
  source 1..24: mol_type = other RNA
atctggtacgacggcagcaacaag

SEQ ID NO: 14421 - RNA, 24 nt, synthetic construct
  misc_feature 1..24: note = derived and/or modified sequence opt1 from anti-influenza_CDR
  source 1..24: mol_type = other RNA
cagacctacggcggggtgagcacc

SEQ ID NO: 14422 - RNA, 24 nt, synthetic construct
  misc_feature 1..24: note = derived and/or modified sequence opt1 from anti-influenza_CDR
  source 1..24: mol_type = other RNA
gacagcgccggcaaccgccactcc

SEQ ID NO: 14423 - RNA, 24 nt, synthetic construct
  misc_feature 1..24: note = derived and/or modified sequence opt1 from anti-influenza_CDR
  source 1..24: mol_type = other RNA
ttccgcggcgggaacagcctgtcc

SEQ ID NO: 14424 - RNA, 24 nt, synthetic construct
  misc_feature 1..24: note = derived and/or modified sequence opt1 from anti-influenza_CDR
  source 1..24: mol_type = other RNA
ggctacaccttcaccacgtactgg

SEQ ID NO: 14425 - RNA, 24 nt, synthetic construct
  misc_feature 1..24: note = derived and/or modified sequence opt1 from anti-influenza_CDR
  source 1..24: mol_type = other RNA
atcgacccctacgacagcgagacc

SEQ ID NO: 14426 - RNA, 24 nt, synthetic construct
  misc_feature 1..24: note = derived and/or modified sequence opt1 from anti-influenza_CDR
  source 1..24: mol_type = other RNA
atccgcaagttcctgaactggtac

SEQ ID NO: 14427 - RNA, 24 nt, synthetic construct
  misc_feature 1..24: note = derived and/or modified sequence opt1 from anti-influenza_CDR
  source 1..24: mol_type = other RNA
cagcagtacgacggcctgcccttc

SEQ ID NO: 14428 - RNA, 24 nt, synthetic construct
  misc_feature 1..24: note = derived and/or modified sequence opt1 from anti-influenza_CDR
  source 1..24: mol_type = other RNA
atccgcaacagcctgaactggtac

SEQ ID NO: 14429 - RNA, 24 nt, synthetic construct
  misc_feature 1..24: note = derived and/or modified sequence opt1 from anti-influenza_CDR
  source 1..24: mol_type = other RNA
cagcaggccaacagcttccccctg

SEQ ID NO: 14430 - RNA, 24 nt, synthetic construct
  misc_feature 1..24: note = derived and/or modified sequence opt1 from anti-influenza_CDR
  source 1..24: mol_type = other RNA
agcctgctcaccgaggtggagacc

SEQ ID NO: 14431 - RNA, 24 nt, synthetic construct
  misc_feature 1..24: note = derived and/or modified sequence opt1 from anti-influenza_CDR
  source 1..24: mol_type = other RNA
cagcagagctactccatgcccgcc

SEQ ID NO: 14432 - RNA, 24 nt, synthetic construct
  misc_feature 1..24: note = derived and/or modified sequence opt1 from anti-influenza_CDR
  source 1..24: mol_type = other RNA
ggcgggcccgtgagcggcgggggc

SEQ ID NO: 14433 - RNA, 24 nt, synthetic construct
  misc_feature 1..24: note = derived and/or modified sequence opt1 from anti-influenza_CDR
  source 1..24: mol_type = other RNA
cagcagagcttctccgtgcccgcc

SEQ ID NO: 14434 - RNA, 24 nt, synthetic construct
  misc_feature 1..24: note = derived and/or modified sequence opt1 from anti-influenza_CDR
  source 1..24: mol_type = other RNA
cagcagacctacagcatccccctg

SEQ ID NO: 14435 - RNA, 24 nt, synthetic construct
  misc_feature 1..24: note = derived and/or modified sequence opt1 from anti-influenza_CDR
  source 1..24: mol_type = other RNA
cagcagagctactccgtgcccgcc

SEQ ID NO: 14436 - RNA, 24 nt, synthetic construct
  misc_feature 1..24: note = derived and/or modified sequence opt1 from anti-influenza_CDR
  source 1..24: mol_type = other RNA
cagcagaccttcagcatccccctg

SEQ ID NO: 14437 - RNA, 24 nt, synthetic construct
  misc_feature 1..24: note = derived and/or modified sequence opt1 from anti-influenza_CDR
  source 1..24: mol_type = other RNA
ggcgacagcatcacctccggggcc

SEQ ID NO: 14438 - RNA, 24 nt, synthetic construct
  misc_feature 1..24: note = derived and/or modified sequence opt1 from anti-influenza_CDR
  source 1..24: mol_type = other RNA
caggcctgggacagctccaccgcc

SEQ ID NO: 14439 - RNA, 24 nt, synthetic construct
  misc_feature 1..24: note = derived and/or modified sequence opt1 from anti-influenza_CDR
  source 1..24: mol_type = other RNA
cagcagtacggcagctccctgtgg

SEQ ID NO: 14440 - RNA, 24 nt, synthetic construct
  misc_feature 1..24: note = derived and/or modified sequence opt1 from anti-influenza_CDR
  source 1..24: mol_type = other RNA
gcctacggctacaccttcgacccc

SEQ ID NO: 14441 - RNA, 24 nt, synthetic construct
  misc_feature 1..24: note = derived and/or modified sequence opt1 from anti-influenza_CDR
  source 1..24: mol_type = other RNA
atgcaggccctgcagacccccctc

SEQ ID NO: 14442 - RNA, 24 nt, synthetic construct
  misc_feature 1..24: note = derived and/or modified sequence opt1 from anti-influenza_CDR
  source 1..24: mol_type = other RNA
cagcagtacggcagctccctgacc

SEQ ID NO: 14443 - RNA, 24 nt, synthetic construct
  misc_feature 1..24: note = derived and/or modified sequence opt1 from anti-influenza_CDR
  source 1..24: mol_type = other RNA
cagaagtacaacagcgccccctcc

SEQ ID NO: 14444 - RNA, 24 nt, synthetic construct
  misc_feature 1..24: note = derived and/or modified sequence opt1 from anti-influenza_CDR
  source 1..24: mol_type = other RNA
cagcagcgcagcaactggctgaag

SEQ ID NO: 14445 - RNA, 24 nt, synthetic construct
  misc_feature 1..24: note = derived and/or modified sequence opt1 from anti-influenza_CDR
  source 1..24: mol_type = other RNA
agctcccagagccgctccagcacc

SEQ ID NO: 14446 - RNA, 24 nt, synthetic construct
  misc_feature 1..24: note = derived and/or modified sequence opt1 from anti-influenza_CDR
  source 1..24: mol_type = other RNA
ccctacgacgtgccggactacgag

SEQ ID NO: 14447 - RNA, 24 nt, synthetic construct
  misc_feature 1..24: note = derived and/or modified sequence opt1 from anti-influenza_CDR
  source 1..24: mol_type = other RNA
ccctacgacgtgccggactacgcc

SEQ ID NO: 14448 - RNA, 24 nt, synthetic construct
  misc_feature 1..24: note = derived and/or modified sequence opt1 from anti-influenza_CDR
  source 1..24: mol_type = other RNA
cccggcgacttcaacgactacgag

SEQ ID NO: 14449 - RNA, 24 nt, synthetic construct
  misc_feature 1..24: note = derived and/or modified sequence opt1 from anti-influenza_CDR
  source 1..24: mol_type = other RNA
cccaaggtgcgcgaccaggagagc

SEQ ID NO: 14450 - RNA, 24 nt, synthetic construct
  misc_feature 1..24: note = derived and/or modified sequence opt1 from anti-influenza_CDR
  source 1..24: mol_type = other RNA
accagctacacctccagcaacacg

SEQ ID NO: 14451 - RNA, 24 nt, synthetic construct
  misc_feature 1..24: note = derived and/or modified sequence opt1 from anti-influenza_CDR
  source 1..24: mol_type = other RNA
ggcgggaacttcaacaactacgcc

SEQ ID NO: 14452 - RNA, 24 nt, synthetic construct
  misc_feature 1..24: note = derived and/or modified sequence opt1 from anti-influenza_CDR
  source 1..24: mol_type = other RNA
atcagccccatcttcggctccacc

SEQ ID NO: 14453 - RNA, 24 nt, synthetic construct
  misc_feature 1..24: note = derived and/or modified sequence opt1 from anti-influenza_CDR
  source 1..24: mol_type = other RNA
agctcctacaccagctccaacacc

SEQ ID NO: 14454 - RNA, 24 nt, synthetic construct
  misc_feature 1..24: note = derived and/or modified sequence opt1 from anti-influenza_CDR
  source 1..24: mol_type = other RNA
ggcgggaccttcaacaactacgcc

SEQ ID NO: 14455 - RNA, 24 nt, synthetic construct
  misc_feature 1..24: note = derived and/or modified sequence opt1 from anti-influenza_CDR
  source 1..24: mol_type = other RNA
atcagccccatcttcggctccgtg

SEQ ID NO: 14456 - RNA, 24 nt, synthetic construct
  misc_feature 1..24: note = derived and/or modified sequence opt1 from anti-influenza_CDR
  source 1..24: mol_type = other RNA
agctccaacatcggccacaacttc

SEQ ID NO: 14457 - RNA, 24 nt, synthetic construct
  misc_feature 1..24: note = derived and/or modified sequence opt1 from anti-influenza_CDR
  source 1..24: mol_type = other RNA
ggcacctgggacagctccctgagc

SEQ ID NO: 14458 - RNA, 24 nt, synthetic construct
  misc_feature 1..24: note = derived and/or modified sequence opt1 from anti-influenza_CDR
  source 1..24: mol_type = other RNA
ggcgggatcatccgcaagtacgcc

SEQ ID NO: 14459 - RNA, 24 nt, synthetic construct
  misc_feature 1..24: note = derived and/or modified sequence opt1 from anti-influenza_CDR
  source 1..24: mol_type = other RNA
atcatcgccatcttcaacaccgcc

SEQ ID NO: 14460 - RNA, 24 nt, synthetic construct
  misc_feature 1..24: note = derived and/or modified sequence opt1 from anti-influenza_CDR
  source 1..24: mol_type = other RNA
ggctacaccttcaccgcctacacg

SEQ ID NO: 14461 - RNA, 24 nt, synthetic construct
  misc_feature 1..24: note = derived and/or modified sequence opt1 from anti-influenza_CDR
  source 1..24: mol_type = other RNA
atcaacgccggcaacgggcacacc

SEQ ID NO: 14462 - RNA, 24 nt, synthetic construct
  misc_feature 1..24: note = derived and/or modified sequence opt1 from anti-influenza_CDR
  source 1..24: mol_type = other RNA
ggcgggaccttcatcaactacgcc

SEQ ID NO: 14463 - RNA, 24 nt, synthetic construct
  misc_feature 1..24: note = derived and/or modified sequence opt1 from anti-influenza_CDR
  source 1..24: mol_type = other RNA
atcatccccgtgtacggcaccagc

SEQ ID NO: 14464 - RNA, 24 nt, synthetic construct
  misc_feature 1..24: note = derived and/or modified sequence opt1 from anti-influenza_CDR
  source 1..24: mol_type = other RNA
ggcttcaccttccgcagccacgcc

SEQ ID NO: 14465 - RNA, 24 nt, synthetic construct
  misc_feature 1..24: note = derived and/or modified sequence opt1 from anti-influenza_CDR
  source 1..24: mol_type = other RNA
atcagctacgacgaggtgaacaag

SEQ ID NO: 14466 - RNA, 24 nt, synthetic construct
  misc_feature 1..24: note = derived and/or modified sequence opt1 from anti-influenza_CDR
  source 1..24: mol_type = other RNA
ggctacaacttcgccgcctactac

SEQ ID NO: 14467 - RNA, 24 nt, synthetic construct
  misc_feature 1..24: note = derived and/or modified sequence opt1 from anti-influenza_CDR
  source 1..24: mol_type = other RNA
agcaaccccaacaccggcggggcc

SEQ ID NO: 14468 - RNA, 24 nt, synthetic construct
  misc_feature 1..24: note = derived and/or modified sequence opt1 from anti-influenza_CDR
  source 1..24: mol_type = other RNA
ggctacaccctgatcgactactac

SEQ ID NO: 14469 - RNA, 24 nt, synthetic construct
  misc_feature 1..24: note = derived and/or modified sequence opt1 from anti-influenza_CDR
  source 1..24: mol_type = other RNA
atcaaccccatcaacggcgggacc

SEQ ID NO: 14470 - RNA, 24 nt, synthetic construct
  misc_feature 1..24: note = derived and/or modified sequence opt1 from anti-influenza_CDR
  source 1..24: mol_type = other RNA
ggcttcaccttcagcgcctacgcc

SEQ ID NO: 14471 - RNA, 24 nt, synthetic construct
  misc_feature 1..24: note = derived and/or modified sequence opt1 from anti-influenza_CDR
  source 1..24: mol_type = other RNA
accagctacgacggccgcgactcc

SEQ ID NO: 14472 - RNA, 24 nt, synthetic construct
  misc_feature 1..24: note = derived and/or modified sequence opt1 from anti-influenza_CDR
  source 1..24: mol_type = other RNA
ggcttcaccttcaccaactacgcc

SEQ ID NO: 14473 - RNA, 24 nt, synthetic construct
  misc_feature 1..24: note = derived and/or modified sequence opt1 from anti-influenza_CDR
  source 1..24: mol_type = other RNA
atcagcttcgacgaggacaacaag

SEQ ID NO: 14474 - RNA, 24 nt, synthetic construct
  misc_feature 1..24: note = derived and/or modified sequence opt1 from anti-influenza_CDR
  source 1..24: mol_type = other RNA
ggcttcaacttcagctcctacggg

SEQ ID NO: 14475 - RNA, 24 nt, synthetic construct
  misc_feature 1..24: note = derived and/or modified sequence opt1 from anti-influenza_CDR
  source 1..24: mol_type = other RNA
atctggagcggcgggtccaacaag

SEQ ID NO: 14476 - RNA, 24 nt, synthetic construct
  misc_feature 1..24: note = derived and/or modified sequence opt1 from anti-influenza_CDR
  source 1..24: mol_type = other RNA
ggcttcatcttcggggacttcgcc

SEQ ID NO: 14477 - RNA, 24 nt, synthetic construct
  misc_feature 1..24: note = derived and/or modified sequence opt1 from anti-influenza_CDR
  source 1..24: mol_type = other RNA
ggcttcaacttcgacgagtacgtg

SEQ ID NO: 14478 - RNA, 24 nt, synthetic construct
  misc_feature 1..24: note = derived and/or modified sequence opt1 from anti-influenza_CDR
  source 1..24: mol_type = other RNA
atcggcgccgacgggcgcggcacc

SEQ ID NO: 14479 - RNA, 24 nt, synthetic construct
  misc_feature 1..24: note = derived and/or modified sequence opt1 from anti-influenza_CDR
  source 1..24: mol_type = other RNA
ggcgggagcgtgtccaactactac

SEQ ID NO: 14480 - RNA, 24 nt, synthetic construct
  misc_feature 1..24: note = derived and/or modified sequence opt1 from anti-influenza_CDR
  source 1..24: mol_type = other RNA
ggcgggaccttcagctactacgcc

SEQ ID NO: 14481 - RNA, 24 nt, synthetic construct
  misc_feature 1..24: note = derived and/or modified sequence opt1 from anti-influenza_CDR
  source 1..24: mol_type = other RNA
atcatccccatcgtgggcaccgcc

SEQ ID NO: 14482 - RNA, 24 nt, synthetic construct
  misc_feature 1..24: note = derived and/or modified sequence opt1 from anti-influenza_CDR
  source 1..24: mol_type = other RNA
accagcaacatcggctccaacacc

SEQ ID NO: 14483 - RNA, 24 nt, synthetic construct
  misc_feature 1..24: note = derived and/or modified sequence opt1 from anti-influenza_CDR
  source 1..24: mol_type = other RNA
ggctacaacttccccaagtactgg

SEQ ID NO: 14484 - RNA, 24 nt, synthetic construct
  misc_feature 1..24: note = derived and/or modified sequence opt1 from anti-influenza_CDR
  source 1..24: mol_type = other RNA
atctaccccggcgacagcgacgtg

SEQ ID NO: 14485 - RNA, 24 nt, synthetic construct
  misc_feature 1..24: note = derived and/or modified sequence opt1 from anti-influenza_CDR
  source 1..24: mol_type = other RNA
ggccacaccttcatcagctacgcc

SEQ ID NO: 14486 - RNA, 24 nt, synthetic construct
  misc_feature 1..24: note = derived and/or modified sequence opt1 from anti-influenza_CDR
  source 1..24: mol_type = other RNA
atcgtgcccatcttcggcaccgtc

SEQ ID NO: 14487 - RNA, 24 nt, synthetic construct
  misc_feature 1..24: note = derived and/or modified sequence opt1 from anti-influenza_CDR
  source 1..24: mol_type = other RNA
ggcttcaccttccgcacctacggg

SEQ ID NO: 14488 - RNA, 24 nt, synthetic construct
  misc_feature 1..24: note = derived and/or modified sequence opt1 from anti-influenza_CDR
  source 1..24: mol_type = other RNA
atcagctacgacggcaccaacaag

SEQ ID NO: 14489 - RNA, 24 nt, synthetic construct
  misc_feature 1..24: note = derived and/or modified sequence opt1 from anti-influenza_CDR
  source 1..24: mol_type = other RNA
ggcttcaccttcagctcctacggg

SEQ ID NO: 14490 - RNA, 24 nt, synthetic construct
  misc_feature 1..24: note = derived and/or modified sequence opt1 from anti-influenza_CDR
  source 1..24: mol_type = other RNA
atcagctacgacgagatcaacaag

SEQ ID NO: 14491 - RNA, 24 nt, synthetic construct
  misc_feature 1..24: note = derived and/or modified sequence opt1 from anti-influenza_CDR
  source 1..24: mol_type = other RNA
ggcttcagcctgtggacctccggg

SEQ ID NO: 14492 - RNA, 24 nt, synthetic construct
  misc_feature 1..24: note = derived and/or modified sequence opt1 from anti-influenza_CDR
  source 1..24: mol_type = other RNA
atgagctacgacgagaccaagaag

SEQ ID NO: 14493 - RNA, 24 nt, synthetic construct
  misc_feature 1..24: note = derived and/or modified sequence opt1 from anti-influenza_CDR
  source 1..24: mol_type = other RNA
ggcttcaccttcagccgctactcc

SEQ ID NO: 14494 - RNA, 24 nt, synthetic construct
  misc_feature 1..24: note = derived and/or modified sequence opt1 from anti-influenza_CDR
  source 1..24: mol_type = other RNA
atcagcgacacctcccgcaccatc

SEQ ID NO: 14495 - RNA, 24 nt, synthetic construct
  misc_feature 1..24: note = derived and/or modified sequence opt1 from anti-influenza_CDR
  source 1..24: mol_type = other RNA
ggcttcaccttcaacagctacgcc

SEQ ID NO: 14496 - RNA, 24 nt, synthetic construct
  misc_feature 1..24: note = derived and/or modified sequence opt1 from anti-influenza_CDR
  source 1..24: mol_type = other RNA
atccgcggcagcggggagaacacc

SEQ ID NO: 14497 - RNA, 24 nt, synthetic construct
  misc_feature 1..24: note = derived and/or modified sequence opt1 from anti-influenza_CDR
  source 1..24: mol_type = other RNA
ggcttcaccttcagccgcttctcc

SEQ ID NO: 14498 - RNA, 24 nt, synthetic construct
  misc_feature 1..24: note = derived and/or modified sequence opt1 from anti-influenza_CDR
  source 1..24: mol_type = other RNA
atcagcgacaccggccgcaccatc

SEQ ID NO: 14499 - RNA, 24 nt, synthetic construct
  misc_feature 1..24: note = derived and/or modified sequence opt1 from anti-influenza_CDR
  source 1..24: mol_type = other RNA
ggcgacagcttcacctcctactgg

SEQ ID NO: 14500 - RNA, 24 nt, synthetic construct
  misc_feature 1..24: note = derived and/or modified sequence opt1 from anti-influenza_CDR
  source 1..24: mol_type = other RNA
atctacccccgcgacagcgagacc

SEQ ID NO: 14501 - RNA, 24 nt, synthetic construct
  misc_feature 1..24: note = derived and/or modified sequence opt1 from anti-influenza_CDR
  source 1..24: mol_type = other RNA
ggctacaccttcaccgcctaccac

SEQ ID NO: 14502 - RNA, 24 nt, synthetic construct
  misc_feature 1..24: note = derived and/or modified sequence opt1 from anti-influenza_CDR
  source 1..24: mol_type = other RNA
atcaaccccaacagcggcgccacc

SEQ ID NO: 14503 - RNA, 24 nt, synthetic construct
  misc_feature 1..24: note = derived and/or modified sequence opt1 from anti-influenza_CDR
  source 1..24: mol_type = other RNA
ggcttcaccttcagcgactactgg

SEQ ID NO: 14504 - RNA, 24 nt, synthetic construct
  misc_feature 1..24: note = derived and/or modified sequence opt1 from anti-influenza_CDR
  source 1..24: mol_type = other RNA
atcagctccgacggcagcaccacc

SEQ ID NO: 14505 - RNA, 24 nt, synthetic construct
  misc_feature 1..24: note = derived and/or modified sequence opt1 from anti-influenza_CDR
  source 1..24: mol_type = other RNA
ggcttcagcttctccaacgcctgg

SEQ ID NO: 14506 - RNA, 24 nt, synthetic construct
  misc_feature 1..24: note = derived and/or modified sequence opt1 from anti-influenza_CDR
  source 1..24: mol_type = other RNA
ggcctgaccttcagcaacgcctgg

SEQ ID NO: 14507 - RNA, 24 nt, synthetic construct
  misc_feature 1..24: note = derived and/or modified sequence opt1 from anti-influenza_CDR
  source 1..24: mol_type = other RNA
ggcttcaccttcagcaacgcctgg

SEQ ID NO: 14508 - RNA, 24 nt, synthetic construct
  misc_feature 1..24: note = derived and/or modified sequence opt1 from anti-influenza_CDR
  source 1..24: mol_type = other RNA
ggcctgagcttcctcaacgcctgg

SEQ ID NO: 14509 - RNA, 24 nt, synthetic construct
  misc_feature 1..24: note = derived and/or modified sequence opt1 from anti-influenza_CDR
  source 1..24: mol_type = other RNA
ggcttcagcttcctgaacgcctgg

SEQ ID NO: 14510 - RNA, 24 nt, synthetic construct
  misc_feature 1..24: note = derived and/or modified sequence opt1 from anti-influenza_CDR
  source 1..24: mol_type = other RNA
ggcctgaccttcctcaacgcctgg

SEQ ID NO: 14511 - RNA, 24 nt, synthetic construct
  misc_feature 1..24: note = derived and/or modified sequence opt1 from anti-influenza_CDR
  source 1..24: mol_type = other RNA
ggcttcaccttcctgaacgcctgg

SEQ ID NO: 14512 - RNA, 24 nt, synthetic construct
  misc_feature 1..24: note = derived and/or modified sequence opt1 from anti-influenza_CDR
  source 1..24: mol_type = other RNA
ggctacaccttcaccgactactac

SEQ ID NO: 14513 - RNA, 24 nt, synthetic construct
  misc_feature 1..24: note = derived and/or modified sequence opt1 from anti-influenza_CDR
  source 1..24: mol_type = other RNA
gtgaacccctacagcggcgggacc

SEQ ID NO: 14514 - RNA, 24 nt, synthetic construct
  misc_feature 1..24: note = derived and/or modified sequence opt1 from anti-influenza_CDR
  source 1..24: mol_type = other RNA
ggctacaccttcaccgactacaac

SEQ ID NO: 14515 - RNA, 24 nt, synthetic construct
  misc_feature 1..24: note = derived and/or modified sequence opt1 from anti-influenza_CDR
  source 1..24: mol_type = other RNA
atctaccccaacaacggcgggacc

SEQ ID NO: 14516 - RNA, 24 nt, synthetic construct
  misc_feature 1..24: note = derived and/or modified sequence opt1 from anti-influenza_CDR
  source 1..24: mol_type = other RNA
ggctacaccttcaccgggtacaac

SEQ ID NO: 14517 - RNA, 24 nt, synthetic construct
  misc_feature 1..24: note = derived and/or modified sequence opt1 from anti-influenza_CDR
  source 1..24: mol_type = other RNA
atctaccccaacaacggcgtgacc

SEQ ID NO: 14518 - RNA, 24 nt, synthetic construct
  misc_feature 1..24: note = derived and/or modified sequence opt1 from anti-influenza_CDR
  source 1..24: mol_type = other RNA
atggagaccgacaccctgctcctg

SEQ ID NO: 14519 - RNA, 27 nt, synthetic construct
  misc_feature 1..27: note = derived and/or modified sequence opt1 from anti-influenza_CDR
  source 1..27: mol_type = other RNA
gacggcgtgaccaacaaggtcaacagc

SEQ ID NO: 14520 - RNA, 27 nt, synthetic construct
  misc_feature 1..27: note = derived and/or modified sequence opt1 from anti-influenza_CDR
  source 1..27: mol_type = other RNA
ggcagcgacgtggggtccagcaacctg

SEQ ID NO: 14521 - RNA, 27 nt, synthetic construct
  misc_feature 1..27: note = derived and/or modified sequence opt1 from anti-influenza_CDR
  source 1..27: mol_type = other RNA
atgcagaacatcctgctccccctgacc

SEQ ID NO: 14522 - RNA, 27 nt, synthetic construct
  misc_feature 1..27: note = derived and/or modified sequence opt1 from anti-influenza_CDR
  source 1..27: mol_type = other RNA
atgcagagcctgcagctccccctgacc

SEQ ID NO: 14523 - RNA, 27 nt, synthetic construct
  misc_feature 1..27: note = derived and/or modified sequence opt1 from anti-influenza_CDR
  source 1..27: mol_type = other RNA
cagcagcactaccgcaccccgcccacc

SEQ ID NO: 14524 - RNA, 27 nt, synthetic construct
  misc_feature 1..27: note = derived and/or modified sequence opt1 from anti-influenza_CDR
  source 1..27: mol_type = other RNA
cagcagtacggcaacagcccctacacc

SEQ ID NO: 14525 - RNA, 27 nt, synthetic construct
  misc_feature 1..27: note = derived and/or modified sequence opt1 from anti-influenza_CDR
  source 1..27: mol_type = other RNA
cagcagtacggcagctccccctacacc

SEQ ID NO: 14526 - RNA, 27 nt, synthetic construct
  misc_feature 1..27: note = derived and/or modified sequence opt1 from anti-influenza_CDR
  source 1..27: mol_type = other RNA
cagcagtacggcaccagcccccagacc

SEQ ID NO: 14527 - RNA, 27 nt, synthetic construct
  misc_feature 1..27: note = derived and/or modified sequence opt1 from anti-influenza_CDR
  source 1..27: mol_type = other RNA
cagcagtacggctacctgcccctcacc

SEQ ID NO: 14528 - RNA, 27 nt, synthetic construct
  misc_feature 1..27: note = derived and/or modified sequence opt1 from anti-influenza_CDR
  source 1..27: mol_type = other RNA
caggcctgggacagctccaccgccgtg

SEQ ID NO: 14529 - RNA, 27 nt, synthetic construct
  misc_feature 1..27: note = derived and/or modified sequence opt1 from anti-influenza_CDR
  source 1..27: mol_type = other RNA
cagcactacaacgcctactggggcacc

SEQ ID NO: 14530 - RNA, 27 nt, synthetic construct
  misc_feature 1..27: note = derived and/or modified sequence opt1 from anti-influenza_CDR
  source 1..27: mol_type = other RNA
cagcagacctacagctccccgcccacc

SEQ ID NO: 14531 - RNA, 27 nt, synthetic construct
  misc_feature 1..27: note = derived and/or modified sequence opt1 from anti-influenza_CDR
  source 1..27: mol_type = other RNA
cagcagtactacagcttcccctacacc

SEQ ID NO: 14532 - RNA, 27 nt, synthetic construct
  misc_feature 1..27: note = derived and/or modified sequence opt1 from anti-influenza_CDR
  source 1..27: mol_type = other RNA
atgcaggccctgcagctccccctggcc

SEQ ID NO: 14533 - RNA, 27 nt, synthetic construct
  misc_feature 1..27: note = derived and/or modified sequence opt1 from anti-influenza_CDR
  source 1..27: mol_type = other RNA
cagcaggccaacagcttccccttcacc

SEQ ID NO: 14534 - RNA, 27 nt, synthetic construct
  misc_feature 1..27: note = derived and/or modified sequence opt1 from anti-influenza_CDR
  source 1..27: mol_type = other RNA
cagcagctgaacggctaccccctcacc

SEQ ID NO: 14535 - RNA, 27 nt, synthetic construct
  misc_feature 1..27: note = derived and/or modified sequence opt1 from anti-influenza_CDR
  source 1..27: mol_type = other RNA
atgcaggccctgcagacccccctcacc

SEQ ID NO: 14536 - RNA, 27 nt, synthetic construct
  misc_feature 1..27: note = derived and/or modified sequence opt1 from anti-influenza_CDR
  source 1..27: mol_type = other RNA
cagcagaactacaactggcccctgacc

SEQ ID NO: 14537 - RNA, 27 nt, synthetic construct
  misc_feature 1..27: note = derived and/or modified sequence opt1 from anti-influenza_CDR
  source 1..27: mol_type = other RNA
cagcagtacgacaccagctccggcctg

SEQ ID NO: 14538 - RNA, 27 nt, synthetic construct
  misc_feature 1..27: note = derived and/or modified sequence opt1 from anti-influenza_CDR
  source 1..27: mol_type = other RNA
cagcagtacaacagctggccccgcacc

SEQ ID NO: 14539 - RNA, 27 nt, synthetic construct
  misc_feature 1..27: note = derived and/or modified sequence opt1 from anti-influenza_CDR
  source 1..27: mol_type = other RNA
gtgatctacagccacggccgcgcctac

SEQ ID NO: 14540 - RNA, 27 nt, synthetic construct
  misc_feature 1..27: note = derived and/or modified sequence opt1 from anti-influenza_CDR
  source 1..27: mol_type = other RNA
cagcagtacggcgacagccgctacacc

SEQ ID NO: 14541 - RNA, 27 nt, synthetic construct
  misc_feature 1..27: note = derived and/or modified sequence opt1 from anti-influenza_CDR
  source 1..27: mol_type = other RNA
ctgcagcacaacagctacccctacacc

SEQ ID NO: 14542 - RNA, 27 nt, synthetic construct
  misc_feature 1..27: note = derived and/or modified sequence opt1 from anti-influenza_CDR
  source 1..27: mol_type = other RNA
cgcaagatgaccaccgccttcgacagc

SEQ ID NO: 14543 - RNA, 27 nt, synthetic construct
  misc_feature 1..27: note = derived and/or modified sequence opt1 from anti-influenza_CDR
  source 1..27: mol_type = other RNA
cagcgcaaccacagcccctcctggacc

SEQ ID NO: 14544 - RNA, 27 nt, synthetic construct
  misc_feature 1..27: note = derived and/or modified sequence opt1 from anti-influenza_CDR
  source 1..27: mol_type = other RNA
cagcagagctacgacaacccccagacc

SEQ ID NO: 14545 - RNA, 27 nt, synthetic construct
  misc_feature 1..27: note = derived and/or modified sequence opt1 from anti-influenza_CDR
  source 1..27: mol_type = other RNA
cagcagagccgccggctgccctacacc

SEQ ID NO: 14546 - RNA, 27 nt, synthetic construct
  misc_feature 1..27: note = derived and/or modified sequence opt1 from anti-influenza_CDR
  source 1..27: mol_type = other RNA
cgcaagatgaccaccgccatcgactac

SEQ ID NO: 14547 - RNA, 27 nt, synthetic construct
  misc_feature 1..27: note = derived and/or modified sequence opt1 from anti-influenza_CDR
  source 1..27: mol_type = other RNA
atccgctacaccggccagcagctgctc

SEQ ID NO: 14548 - RNA, 27 nt, synthetic construct
  misc_feature 1..27: note = derived and/or modified sequence opt1 from anti-influenza_CDR
  source 1..27: mol_type = other RNA
cagcactacggcaccatcagccagacc

SEQ ID NO: 14549 - RNA, 27 nt, synthetic construct
  misc_feature 1..27: note = derived and/or modified sequence opt1 from anti-influenza_CDR
  source 1..27: mol_type = other RNA
cagcagtacagcacctccccgcccacc

SEQ ID NO: 14550 - RNA, 27 nt, synthetic construct
  misc_feature 1..27: note = derived and/or modified sequence opt1 from anti-influenza_CDR
  source 1..27: mol_type = other RNA
cagcagtacggcaacagccccatcacc

SEQ ID NO: 14551 - RNA, 27 nt, synthetic construct
  misc_feature 1..27: note = derived and/or modified sequence opt1 from anti-influenza_CDR
  source 1..27: mol_type = other RNA
cagcagtactacagccgcccctacacc

SEQ ID NO: 14552 - RNA, 27 nt, synthetic construct
  misc_feature 1..27: note = derived and/or modified sequence opt1 from anti-influenza_CDR
  source 1..27: mol_type = other RNA
caggtgtgggacaacttcggcggggtc

SEQ ID NO: 14553 - RNA, 27 nt, synthetic construct
  misc_feature 1..27: note = derived and/or modified sequence opt1 from anti-influenza_CDR
  source 1..27: mol_type = other RNA
cagcagagctactccagccccctgacc

SEQ ID NO: 14554 - RNA, 27 nt, synthetic construct
  misc_feature 1..27: note = derived and/or modified sequence opt1 from anti-influenza_CDR
  source 1..27: mol_type = other RNA
cagcagtacttcgccaccccccgcacc

SEQ ID NO: 14555 - RNA, 27 nt, synthetic construct
  misc_feature 1..27: note = derived and/or modified sequence opt1 from anti-influenza_CDR
  source 1..27: mol_type = other RNA
cagcagtactacttcagccccctgacc

SEQ ID NO: 14556 - RNA, 27 nt, synthetic construct
  misc_feature 1..27: note = derived and/or modified sequence opt1 from anti-influenza_CDR
  source 1..27: mol_type = other RNA
cagcacttcggcaccagcgtgttcacc

SEQ ID NO: 14557 - RNA, 27 nt, synthetic construct
  misc_feature 1..27: note = derived and/or modified sequence opt1 from anti-influenza_CDR
  source 1..27: mol_type = other RNA
cagcagtactacaacgcccccctgacc

SEQ ID NO: 14558 - RNA, 27 nt, synthetic construct
  misc_feature 1..27: note = derived and/or modified sequence opt1 from anti-influenza_CDR
  source 1..27: mol_type = other RNA
gtgctgttcaccagccccttcgacttc

SEQ ID NO: 14559 - RNA, 27 nt, synthetic construct
  misc_feature 1..27: note = derived and/or modified sequence opt1 from anti-influenza_CDR
  source 1..27: mol_type = other RNA
ctgctcagctactccggcgtgtgggtc

SEQ ID NO: 14560 - RNA, 27 nt, synthetic construct
  misc_feature 1..27: note = derived and/or modified sequence opt1 from anti-influenza_CDR
  source 1..27: mol_type = other RNA
ttcctgagctactccggcgcctgggtg

SEQ ID NO: 14561 - RNA, 27 nt, synthetic construct
  misc_feature 1..27: note = derived and/or modified sequence opt1 from anti-influenza_CDR
  source 1..27: mol_type = other RNA
cagcagagcttctccaagagctggacc

SEQ ID NO: 14562 - RNA, 27 nt, synthetic construct
  misc_feature 1..27: note = derived and/or modified sequence opt1 from anti-influenza_CDR
  source 1..27: mol_type = other RNA
gtgcagtacgtccagttcccctggacc

SEQ ID NO: 14563 - RNA, 27 nt, synthetic construct
  misc_feature 1..27: note = derived and/or modified sequence opt1 from anti-influenza_CDR
  source 1..27: mol_type = other RNA
cagcagagctactccccgcccctgacc

SEQ ID NO: 14564 - RNA, 27 nt, synthetic construct
  misc_feature 1..27: note = derived and/or modified sequence opt1 from anti-influenza_CDR
  source 1..27: mol_type = other RNA
ttcatctactacggcgggaacaccaag

SEQ ID NO: 14565 - RNA, 27 nt, synthetic construct
  misc_feature 1..27: note = derived and/or modified sequence opt1 from anti-influenza_CDR
  source 1..27: mol_type = other RNA
gtgatctacagcggcgggtccacctac

SEQ ID NO: 14566 - RNA, 27 nt, synthetic construct
  misc_feature 1..27: note = derived and/or modified sequence opt1 from anti-influenza_CDR
  source 1..27: mol_type = other RNA
ttcatgttccactccggcagcccccgc

SEQ ID NO: 14567 - RNA, 27 nt, synthetic construct
  misc_feature 1..27: note = derived and/or modified sequence opt1 from anti-influenza_CDR
  source 1..27: mol_type = other RNA
cagcagacctacagcacccccatcacg

SEQ ID NO: 14568 - RNA, 27 nt, synthetic construct
  misc_feature 1..27: note = derived and/or modified sequence opt1 from anti-influenza_CDR
  source 1..27: mol_type = other RNA
ttcttctacaacggcgggagcaccaag

SEQ ID NO: 14569 - RNA, 27 nt, synthetic construct
  misc_feature 1..27: note = derived and/or modified sequence opt1 from anti-influenza_CDR
  source 1..27: mol_type = other RNA
cagcagagctacaacacccccctgatc

SEQ ID NO: 14570 - RNA, 27 nt, synthetic construct
  misc_feature 1..27: note = derived and/or modified sequence opt1 from anti-influenza_CDR
  source 1..27: mol_type = other RNA
cacatctacgactacggccgcaccttc

SEQ ID NO: 14571 - RNA, 27 nt, synthetic construct
  misc_feature 1..27: note = derived and/or modified sequence opt1 from anti-influenza_CDR
  source 1..27: mol_type = other RNA
gtgttctacagcgagacccgcacctac

SEQ ID NO: 14572 - RNA, 27 nt, synthetic construct
  misc_feature 1..27: note = derived and/or modified sequence opt1 from anti-influenza_CDR
  source 1..27: mol_type = other RNA
caggtgtggggcagctccagcgaccac

SEQ ID NO: 14573 - RNA, 27 nt, synthetic construct
  misc_feature 1..27: note = derived and/or modified sequence opt1 from anti-influenza_CDR
  source 1..27: mol_type = other RNA
tacgtgtacaaccgcggcagcaccaag

SEQ ID NO: 14574 - RNA, 27 nt, synthetic construct
  misc_feature 1..27: note = derived and/or modified sequence opt1 from anti-influenza_CDR
  source 1..27: mol_type = other RNA
tacatctacaaccgcggcagcaccaag

SEQ ID NO: 14575 - RNA, 27 nt, synthetic construct
  misc_feature 1..27: note = derived and/or modified sequence opt1 from anti-influenza_CDR
  source 1..27: mol_type = other RNA
cagcagagctacaacacccccatcacc

SEQ ID NO: 14576 - RNA, 27 nt, synthetic construct
  misc_feature 1..27: note = derived and/or modified sequence opt1 from anti-influenza_CDR
  source 1..27: mol_type = other RNA
cagcagtactacagctccccgcccacc

SEQ ID NO: 14577 - RNA, 27 nt, synthetic construct
  misc_feature 1..27: note = derived and/or modified sequence opt1 from anti-influenza_CDR
  source 1..27: mol_type = other RNA
tacctgtactacagcggctccaccaag

SEQ ID NO: 14578 - RNA, 27 nt, synthetic construct
  misc_feature 1..27: note = derived and/or modified sequence opt1 from anti-influenza_CDR
  source 1..27: mol_type = other RNA
cagcagagctactccccgcccatcacc

SEQ ID NO: 14579 - RNA, 27 nt, synthetic construct
  misc_feature 1..27: note = derived and/or modified sequence opt1 from anti-influenza_CDR
  source 1..27: mol_type = other RNA
tacgtgtacaacagcggcaacaccaag

SEQ ID NO: 14580 - RNA, 27 nt, synthetic construct
  misc_feature 1..27: note = derived and/or modified sequence opt1 from anti-influenza_CDR
  source 1..27: mol_type = other RNA
cagcagagctacaacacccccctgacc

SEQ ID NO: 14581 - RNA, 27 nt, synthetic construct
  misc_feature 1..27: note = derived and/or modified sequence opt1 from anti-influenza_CDR
  source 1..27: mol_type = other RNA
cacatcttcgacagcggctccacctac

SEQ ID NO: 14582 - RNA, 27 nt, synthetic construct
  misc_feature 1..27: note = derived and/or modified sequence opt1 from anti-influenza_CDR
  source 1..27: mol_type = other RNA
gtgttctacagcgccgaccgcacctcc

SEQ ID NO: 14583 - RNA, 27 nt, synthetic construct
  misc_feature 1..27: note = derived and/or modified sequence opt1 from anti-influenza_CDR
  source 1..27: mol_type = other RNA
cagcagtactacagcacccccctgacc

SEQ ID NO: 14584 - RNA, 27 nt, synthetic construct
  misc_feature 1..27: note = derived and/or modified sequence opt1 from anti-influenza_CDR
  source 1..27: mol_type = other RNA
tacatctactacagcggcaacacctac

SEQ ID NO: 14585 - RNA, 27 nt, synthetic construct
  misc_feature 1..27: note = derived and/or modified sequence opt1 from anti-influenza_CDR
  source 1..27: mol_type = other RNA
cagcagagctactccacccccctgacc

SEQ ID NO: 14586 - RNA, 27 nt, synthetic construct
  misc_feature 1..27: note = derived and/or modified sequence opt1 from anti-influenza_CDR
  source 1..27: mol_type = other RNA
cagcagtacggcagctccagcctgacc

SEQ ID NO: 14587 - RNA, 27 nt, synthetic construct
  misc_feature 1..27: note = derived and/or modified sequence opt1 from anti-influenza_CDR
  source 1..27: mol_type = other RNA
agctcctacaccagctccagcacctac

SEQ ID NO: 14588 - RNA, 27 nt, synthetic construct
  misc_feature 1..27: note = derived and/or modified sequence opt1 from anti-influenza_CDR
  source 1..27: mol_type = other RNA
cagcgctacaacagcgccccgcccatc

SEQ ID NO: 14589 - RNA, 27 nt, synthetic construct
  misc_feature 1..27: note = derived and/or modified sequence opt1 from anti-influenza_CDR
  source 1..27: mol_type = other RNA
cagcagtacggccgcacccccctgacc

SEQ ID NO: 14590 - RNA, 27 nt, synthetic construct
  misc_feature 1..27: note = derived and/or modified sequence opt1 from anti-influenza_CDR
  source 1..27: mol_type = other RNA
cagcagtacggctccagcccccgcacc

SEQ ID NO: 14591 - RNA, 27 nt, synthetic construct
  misc_feature 1..27: note = derived and/or modified sequence opt1 from anti-influenza_CDR
  source 1..27: mol_type = other RNA
cagcagtacggctccagccccctgacc

SEQ ID NO: 14592 - RNA, 27 nt, synthetic construct
  misc_feature 1..27: note = derived and/or modified sequence opt1 from anti-influenza_CDR
  source 1..27: mol_type = other RNA
caggtgtgggacagctccagcgaccac

SEQ ID NO: 14593 - RNA, 27 nt, synthetic construct
  misc_feature 1..27: note = derived and/or modified sequence opt1 from anti-influenza_CDR
  source 1..27: mol_type = other RNA
aaggagttcagcgaggtggagggccgc

SEQ ID NO: 14594 - RNA, 27 nt, synthetic construct
  misc_feature 1..27: note = derived and/or modified sequence opt1 from anti-influenza_CDR
  source 1..27: mol_type = other RNA
aaggagttcaacaacctggagaagcgc

SEQ ID NO: 14595 - RNA, 27 nt, synthetic construct
  misc_feature 1..27: note = derived and/or modified sequence opt1 from anti-influenza_CDR
  source 1..27: mol_type = other RNA
cagcagcactaccgcaccccgcccagc

SEQ ID NO: 14596 - RNA, 27 nt, synthetic construct
  misc_feature 1..27: note = derived and/or modified sequence opt1 from anti-influenza_CDR
  source 1..27: mol_type = other RNA
atgcaggccacccactggcccctgacc

SEQ ID NO: 14597 - RNA, 27 nt, synthetic construct
  misc_feature 1..27: note = derived and/or modified sequence opt1 from anti-influenza_CDR
  source 1..27: mol_type = other RNA
cagcagtactacagctacccctacacc

SEQ ID NO: 14598 - RNA, 27 nt, synthetic construct
  misc_feature 1..27: note = derived and/or modified sequence opt1 from anti-influenza_CDR
  source 1..27: mol_type = other RNA
agctccgacgtgggcgggtacaactac

SEQ ID NO: 14599 - RNA, 27 nt, synthetic construct
  misc_feature 1..27: note = derived and/or modified sequence opt1 from anti-influenza_CDR
  source 1..27: mol_type = other RNA
agctccgacgtgggcgactacaactac

SEQ ID NO: 14600 - RNA, 27 nt, synthetic construct
  misc_feature 1..27: note = derived and/or modified sequence opt1 from anti-influenza_CDR
  source 1..27: mol_type = other RNA
cagcagtacaacaactggcccctgagc

SEQ ID NO: 14601 - RNA, 27 nt, synthetic construct
  misc_feature 1..27: note = derived and/or modified sequence opt1 from anti-influenza_CDR
  source 1..27: mol_type = other RNA
cagcagagctacaactacccccgcacc

SEQ ID NO: 14602 - RNA, 27 nt, synthetic construct
  misc_feature 1..27: note = derived and/or modified sequence opt1 from anti-influenza_CDR
  source 1..27: mol_type = other RNA
atgcagggcctgcagaccccctacacc

SEQ ID NO: 14603 - RNA, 27 nt, synthetic construct
  misc_feature 1..27: note = derived and/or modified sequence opt1 from anti-influenza_CDR
  source 1..27: mol_type = other RNA
cagcagcactacagcatccccctgacc

SEQ ID NO: 14604 - RNA, 27 nt, synthetic construct
  misc_feature 1..27: note = derived and/or modified sequence opt1 from anti-influenza_CDR
  source 1..27: mol_type = other RNA
ctgcagcacaacagctacccctggacc

SEQ ID NO: 14605 - RNA, 27 nt, synthetic construct
  misc_feature 1..27: note = derived and/or modified sequence opt1 from anti-influenza_CDR
  source 1..27: mol_type = other RNA
cagcagtacaacacctggcccctgacc

SEQ ID NO: 14606 - RNA, 27 nt, synthetic construct
  misc_feature 1..27: note = derived and/or modified sequence opt1 from anti-influenza_CDR
  source 1..27: mol_type = other RNA
cagcagtacaacagcttcccctaccgc

SEQ ID NO: 14607 - RNA, 27 nt, synthetic construct
  misc_feature 1..27: note = derived and/or modified sequence opt1 from anti-influenza_CDR
  source 1..27: mol_type = other RNA
cagcagagctactccgcccccttcacc

SEQ ID NO: 14608 - RNA, 27 nt, synthetic construct
  misc_feature 1..27: note = derived and/or modified sequence opt1 from anti-influenza_CDR
  source 1..27: mol_type = other RNA
caggcctgggacagctccaccgtggtc

SEQ ID NO: 14609 - RNA, 27 nt, synthetic construct
  misc_feature 1..27: note = derived and/or modified sequence opt1 from anti-influenza_CDR
  source 1..27: mol_type = other RNA
caggcctgggacagcaccaccgtggtc

SEQ ID NO: 14610 - RNA, 27 nt, synthetic construct
  misc_feature 1..27: note = derived and/or modified sequence opt1 from anti-influenza_CDR
  source 1..27: mol_type = other RNA
ctgcagtacggctccagcccccgcacc

SEQ ID NO: 14611 - RNA, 27 nt, synthetic construct
  misc_feature 1..27: note = derived and/or modified sequence opt1 from anti-influenza_CDR
  source 1..27: mol_type = other RNA
agctccgacgtgggcgggtacgactac

SEQ ID NO: 14612 - RNA, 27 nt, synthetic construct
  misc_feature 1..27: note = derived and/or modified sequence opt1 from anti-influenza_CDR
  source 1..27: mol_type = other RNA
cagcagtacacctactggcccctgacc

SEQ ID NO: 14613 - RNA, 27 nt, synthetic construct
  misc_feature 1..27: note = derived and/or modified sequence opt1 from anti-influenza_CDR
  source 1..27: mol_type = other RNA
cagcagtacgacaagtggcccccgggc

SEQ ID NO: 14614 - RNA, 27 nt, synthetic construct
  misc_feature 1..27: note = derived and/or modified sequence opt1 from anti-influenza_CDR
  source 1..27: mol_type = other RNA
atgcagagcctgcagacctccatcacc

SEQ ID NO: 14615 - RNA, 27 nt, synthetic construct
  misc_feature 1..27: note = derived and/or modified sequence opt1 from anti-influenza_CDR
  source 1..27: mol_type = other RNA
agccagatcgagctggccgtgctcctg

SEQ ID NO: 14616 - RNA, 27 nt, synthetic construct
  misc_feature 1..27: note = derived and/or modified sequence opt1 from anti-influenza_CDR
  source 1..27: mol_type = other RNA
atgcaggccctgcagaccccctacacc

SEQ ID NO: 14617 - RNA, 27 nt, synthetic construct
  misc_feature 1..27: note = derived and/or modified sequence opt1 from anti-influenza_CDR
  source 1..27: mol_type = other RNA
cagcagcgcagccactggcccccgatc

SEQ ID NO: 14618 - RNA, 27 nt, synthetic construct
  misc_feature 1..27: note = derived and/or modified sequence opt1 from anti-influenza_CDR
  source 1..27: mol_type = other RNA
cagcacttctggggcacccccctgacc

SEQ ID NO: 14619 - RNA, 27 nt, synthetic construct
  misc_feature 1..27: note = derived and/or modified sequence opt1 from anti-influenza_CDR
  source 1..27: mol_type = other RNA
cagcagaactacgaggacccctggacc

SEQ ID NO: 14620 - RNA, 27 nt, synthetic construct
  misc_feature 1..27: note = derived and/or modified sequence opt1 from anti-influenza_CDR
  source 1..27: mol_type = other RNA
cagcaggccaacagcttcccgcccacc

SEQ ID NO: 14621 - RNA, 27 nt, synthetic construct
  misc_feature 1..27: note = derived and/or modified sequence opt1 from anti-influenza_CDR
  source 1..27: mol_type = other RNA
cagcagcgcgaccactggcccccgatc

SEQ ID NO: 14622 - RNA, 27 nt, synthetic construct
  misc_feature 1..27: note = derived and/or modified sequence opt1 from anti-influenza_CDR
  source 1..27: mol_type = other RNA
atggacagccgcctgaacctcgtgttc

SEQ ID NO: 14623 - RNA, 27 nt, synthetic construct
  misc_feature 1..27: note = derived and/or modified sequence opt1 from anti-influenza_CDR
  source 1..27: mol_type = other RNA
atgaagctgcccgtgcgcctcctggtc

SEQ ID NO: 14624 - RNA, 30 nt, synthetic construct
  misc_feature 1..30: note = derived and/or modified sequence opt1 from anti-influenza_CDR
  source 1..30: mol_type = other RNA
ggcgacagcgtgacccgcgggggcttctac

SEQ ID NO: 14625 - RNA, 30 nt, synthetic construct
  misc_feature 1..30: note = derived and/or modified sequence opt1 from anti-influenza_CDR
  source 1..30: mol_type = other RNA
cagagcgtgaccttcaacaacaagaactac

SEQ ID NO: 14626 - RNA, 30 nt, synthetic construct
  misc_feature 1..30: note = derived and/or modified sequence opt1 from anti-influenza_CDR
  source 1..30: mol_type = other RNA
cagagcgtgaccttcaactacaagaactac

SEQ ID NO: 14627 - RNA, 30 nt, synthetic construct
  misc_feature 1..30: note = derived and/or modified sequence opt1 from anti-influenza_CDR
  source 1..30: mol_type = other RNA
cgcgcccagagcctgtccagctacctccac

SEQ ID NO: 14628 - RNA, 30 nt, synthetic construct
  misc_feature 1..30: note = derived and/or modified sequence opt1 from anti-influenza_CDR
  source 1..30: mol_type = other RNA
agctcctacaccagctccagcacctacgtg

SEQ ID NO: 14629 - RNA, 30 nt, synthetic construct
  misc_feature 1..30: note = derived and/or modified sequence opt1 from anti-influenza_CDR
  source 1..30: mol_type = other RNA
cagcgctacaacagcgccccgcccatcacc

SEQ ID NO: 14630 - RNA, 30 nt, synthetic construct
  misc_feature 1..30: note = derived and/or modified sequence opt1 from anti-influenza_CDR
  source 1..30: mol_type = other RNA
ggcgggagcatctccagcggcacctactac

SEQ ID NO: 14631 - RNA, 30 nt, synthetic construct
  misc_feature 1..30: note = derived and/or modified sequence opt1 from anti-influenza_CDR
  source 1..30: mol_type = other RNA
cagcagagctactccagcctgatgttcacc

SEQ ID NO: 14632 - RNA, 30 nt, synthetic construct
  misc_feature 1..30: note = derived and/or modified sequence opt1 from anti-influenza_CDR
  source 1..30: mol_type = other RNA
ctgctcatctacggcgccagcacccgcgcc

SEQ ID NO: 14633 - RNA, 30 nt, synthetic construct
  misc_feature 1..30: note = derived and/or modified sequence opt1 from anti-influenza_CDR
  source 1..30: mol_type = other RNA
tgcgcctacggcgggaagtacctggtggtc

SEQ ID NO: 14634 - RNA, 30 nt, synthetic construct
  misc_feature 1..30: note = derived and/or modified sequence opt1 from anti-influenza_CDR
  source 1..30: mol_type = other RNA
cgccccgacttctacggcgacttcgagtac

SEQ ID NO: 14635 - RNA, 30 nt, synthetic construct
  misc_feature 1..30: note = derived and/or modified sequence opt1 from anti-influenza_CDR
  source 1..30: mol_type = other RNA
cagcactacggctacagcccccgctacgcc

SEQ ID NO: 14636 - RNA, 30 nt, synthetic construct
  misc_feature 1..30: note = derived and/or modified sequence opt1 from anti-influenza_CDR
  source 1..30: mol_type = other RNA
cagcagcgcagccactggcccccgatcacc

SEQ ID NO: 14637 - RNA, 30 nt, synthetic construct
  misc_feature 1..30: note = derived and/or modified sequence opt1 from anti-influenza_CDR
  source 1..30: mol_type = other RNA
agctcctacgccggcagctccacctgggtg

SEQ ID NO: 14638 - RNA, 30 nt, synthetic construct
  misc_feature 1..30: note = derived and/or modified sequence opt1 from anti-influenza_CDR
  source 1..30: mol_type = other RNA
ctgctctacagcggcggggaccccgtggcc

SEQ ID NO: 14639 - RNA, 30 nt, synthetic construct
  misc_feature 1..30: note = derived and/or modified sequence opt1 from anti-influenza_CDR
  source 1..30: mol_type = other RNA
cagcagtacggcgggagcccccgctacacc

SEQ ID NO: 14640 - RNA, 30 nt, synthetic construct
  misc_feature 1..30: note = derived and/or modified sequence opt1 from anti-influenza_CDR
  source 1..30: mol_type = other RNA
cgctacggcagcgggtacggcttcgactcc

SEQ ID NO: 14641 - RNA, 30 nt, synthetic construct
  misc_feature 1..30: note = derived and/or modified sequence opt1 from anti-influenza_CDR
  source 1..30: mol_type = other RNA
agctcctacgccggcaactacaaccacgtg

SEQ ID NO: 14642 - RNA, 30 nt, synthetic construct
  misc_feature 1..30: note = derived and/or modified sequence opt1 from anti-influenza_CDR
  source 1..30: mol_type = other RNA
cagcagtacatcaactggcgccccctgagc

SEQ ID NO: 14643 - RNA, 30 nt, synthetic construct
  misc_feature 1..30: note = derived and/or modified sequence opt1 from anti-influenza_CDR
  source 1..30: mol_type = other RNA
atcggcgccgggtacgacgtgcactggtac

SEQ ID NO: 14644 - RNA, 30 nt, synthetic construct
  misc_feature 1..30: note = derived and/or modified sequence opt1 from anti-influenza_CDR
  source 1..30: mol_type = other RNA
ctgctcatctacgacaacaacaaccgcccc

SEQ ID NO: 14645 - RNA, 30 nt, synthetic construct
  misc_feature 1..30: note = derived and/or modified sequence opt1 from anti-influenza_CDR
  source 1..30: mol_type = other RNA
cagagctacgacaactccctgagcggctcc

SEQ ID NO: 14646 - RNA, 30 nt, synthetic construct
  misc_feature 1..30: note = derived and/or modified sequence opt1 from anti-influenza_CDR
  source 1..30: mol_type = other RNA
ctgctcatctacgacgccagcaacctgcag

SEQ ID NO: 14647 - RNA, 30 nt, synthetic construct
  misc_feature 1..30: note = derived and/or modified sequence opt1 from anti-influenza_CDR
  source 1..30: mol_type = other RNA
ctgctcatccacgacgccagcaacctggag

SEQ ID NO: 14648 - RNA, 30 nt, synthetic construct
  misc_feature 1..30: note = derived and/or modified sequence opt1 from anti-influenza_CDR
  source 1..30: mol_type = other RNA
gtgcagcgcctgagctacggcatggacgtc

SEQ ID NO: 14649 - RNA, 30 nt, synthetic construct
  misc_feature 1..30: note = derived and/or modified sequence opt1 from anti-influenza_CDR
  source 1..30: mol_type = other RNA
gtgcagaagagctactacggcatggacgtc

SEQ ID NO: 14650 - RNA, 30 nt, synthetic construct
  misc_feature 1..30: note = derived and/or modified sequence opt1 from anti-influenza_CDR
  source 1..30: mol_type = other RNA
agctcctacaccagctccagcacccacgtg

SEQ ID NO: 14651 - RNA, 30 nt, synthetic construct
  misc_feature 1..30: note = derived and/or modified sequence opt1 from anti-influenza_CDR
  source 1..30: mol_type = other RNA
agctcctacaccagctccagcaccctggtg

SEQ ID NO: 14652 - RNA, 30 nt, synthetic construct
  misc_feature 1..30: note = derived and/or modified sequence opt1 from anti-influenza_CDR
  source 1..30: mol_type = other RNA
accaagcgcagccagcagaccgtgatcccc

SEQ ID NO: 14653 - RNA, 30 nt, synthetic construct
  misc_feature 1..30: note = derived and/or modified sequence opt1 from anti-influenza_CDR
  source 1..30: mol_type = other RNA
accagccgctcccagcagaccgtgatcccc

SEQ ID NO: 14654 - RNA, 30 nt, synthetic construct
  misc_feature 1..30: note = derived and/or modified sequence opt1 from anti-influenza_CDR
  source 1..30: mol_type = other RNA
agctccaactacaaccgccggttcaccccc

SEQ ID NO: 14655 - RNA, 30 nt, synthetic construct
  misc_feature 1..30: note = derived and/or modified sequence opt1 from anti-influenza_CDR
  source 1..30: mol_type = other RNA
cgccccaaggtgcgggaccaggagagccgc

SEQ ID NO: 14656 - RNA, 30 nt, synthetic construct
  misc_feature 1..30: note = derived and/or modified sequence opt1 from anti-influenza_CDR
  source 1..30: mol_type = other RNA
cgcccctgggtgcggggcgtcagctcccgc

SEQ ID NO: 14657 - RNA, 30 nt, synthetic construct
  misc_feature 1..30: note = derived and/or modified sequence opt1 from anti-influenza_CDR
  source 1..30: mol_type = other RNA
cgcccctgggtgcggggcctgagctcccgc

SEQ ID NO: 14658 - RNA, 30 nt, synthetic construct
  misc_feature 1..30: note = derived and/or modified sequence opt1 from anti-influenza_CDR
  source 1..30: mol_type = other RNA
cgccccaaggtgcggggccaggccgggcgc

SEQ ID NO: 14659 - RNA, 30 nt, synthetic construct
  misc_feature 1..30: note = derived and/or modified sequence opt1 from anti-influenza_CDR
  source 1..30: mol_type = other RNA
gcccccgccgtggcggcccaggccagcgcc

SEQ ID NO: 14660 - RNA, 30 nt, synthetic construct
  misc_feature 1..30: note = derived and/or modified sequence opt1 from anti-influenza_CDR
  source 1..30: mol_type = other RNA
gtgcaccaccccggcaccgacaacgaccag

SEQ ID NO: 14661 - RNA, 30 nt, synthetic construct
  misc_feature 1..30: note = derived and/or modified sequence opt1 from anti-influenza_CDR
  source 1..30: mol_type = other RNA
ttcggccaggggaccaaggtggagatcaag

SEQ ID NO: 14662 - RNA, 30 nt, synthetic construct
  misc_feature 1..30: note = derived and/or modified sequence opt1 from anti-influenza_CDR
  source 1..30: mol_type = other RNA
ggcttcgccttccacaaccgcgccatgcac

SEQ ID NO: 14663 - RNA, 30 nt, synthetic construct
  misc_feature 1..30: note = derived and/or modified sequence opt1 from anti-influenza_CDR
  source 1..30: mol_type = other RNA
ggcctgaccttcagctcctacgccgtgcac

SEQ ID NO: 14664 - RNA, 30 nt, synthetic construct
  misc_feature 1..30: note = derived and/or modified sequence opt1 from anti-influenza_CDR
  source 1..30: mol_type = other RNA
ggccccaccttcagctcctacgccgtgcac

SEQ ID NO: 14665 - RNA, 30 nt, synthetic construct
  misc_feature 1..30: note = derived and/or modified sequence opt1 from anti-influenza_CDR
  source 1..30: mol_type = other RNA
ggcagcatcttctccaactacgggatcagc

SEQ ID NO: 14666 - RNA, 30 nt, synthetic construct
  misc_feature 1..30: note = derived and/or modified sequence opt1 from anti-influenza_CDR
  source 1..30: mol_type = other RNA
ggctacagcttcaacaactacgggatcaac

SEQ ID NO: 14667 - RNA, 30 nt, synthetic construct
  misc_feature 1..30: note = derived and/or modified sequence opt1 from anti-influenza_CDR
  source 1..30: mol_type = other RNA
ggctacaccttcaacgcctactacatccac

SEQ ID NO: 14668 - RNA, 30 nt, synthetic construct
  misc_feature 1..30: note = derived and/or modified sequence opt1 from anti-influenza_CDR
  source 1..30: mol_type = other RNA
ggctacaccttcaccagcttcatcatgtac

SEQ ID NO: 14669 - RNA, 30 nt, synthetic construct
  misc_feature 1..30: note = derived and/or modified sequence opt1 from anti-influenza_CDR
  source 1..30: mol_type = other RNA
cgcggcaactacgggaacggcttcgcctac

SEQ ID NO: 14670 - RNA, 30 nt, synthetic construct
  misc_feature 1..30: note = derived and/or modified sequence opt1 from anti-influenza_CDR
  source 1..30: mol_type = other RNA
cagcagtacggcagctcccccgccctgacc

SEQ ID NO: 14671 - RNA, 30 nt, synthetic construct
  misc_feature 1..30: note = derived and/or modified sequence opt1 from anti-influenza_CDR
  source 1..30: mol_type = other RNA
caggagtacaacaacgacagccccctgacc

SEQ ID NO: 14672 - RNA, 30 nt, synthetic construct
  misc_feature 1..30: note = derived and/or modified sequence opt1 from anti-influenza_CDR
  source 1..30: mol_type = other RNA
atccgcagcggcctgaaccggttcgagacc

SEQ ID NO: 14673 - RNA, 30 nt, synthetic construct
  misc_feature 1..30: note = derived and/or modified sequence opt1 from anti-influenza_CDR
  source 1..30: mol_type = other RNA
gtgttctacagcggctccagcaactacaac

SEQ ID NO: 14674 - RNA, 30 nt, synthetic construct
  misc_feature 1..30: note = derived and/or modified sequence opt1 from anti-influenza_CDR
  source 1..30: mol_type = other RNA
ggcgccagcatctccaccgggggcaactac

SEQ ID NO: 14675 - RNA, 30 nt, synthetic construct
  misc_feature 1..30: note = derived and/or modified sequence opt1 from anti-influenza_CDR
  source 1..30: mol_type = other RNA
atcttctacagcggcaccaccaagtacaac

SEQ ID NO: 14676 - RNA, 30 nt, synthetic construct
  misc_feature 1..30: note = derived and/or modified sequence opt1 from anti-influenza_CDR
  source 1..30: mol_type = other RNA
gccagctacgccggcacctacatccacctg

SEQ ID NO: 14677 - RNA, 30 nt, synthetic construct
  misc_feature 1..30: note = derived and/or modified sequence opt1 from anti-influenza_CDR
  source 1..30: mol_type = other RNA
cagcagctgaacagctacccgcccatcacc

SEQ ID NO: 14678 - RNA, 30 nt, synthetic construct
  misc_feature 1..30: note = derived and/or modified sequence opt1 from anti-influenza_CDR
  source 1..30: mol_type = other RNA
cagcagttcaacgactggcccttcctgacc

SEQ ID NO: 14679 - RNA, 30 nt, synthetic construct
  misc_feature 1..30: note = derived and/or modified sequence opt1 from anti-influenza_CDR
  source 1..30: mol_type = other RNA
cagcagctgaccacctacccgcccatcacg

SEQ ID NO: 14680 - RNA, 30 nt, synthetic construct
  misc_feature 1..30: note = derived and/or modified sequence opt1 from anti-influenza_CDR
  source 1..30: mol_type = other RNA
ggcgggagcatctccaacggcgggtaccac

SEQ ID NO: 14681 - RNA, 30 nt, synthetic construct
  misc_feature 1..30: note = derived and/or modified sequence opt1 from anti-influenza_CDR
  source 1..30: mol_type = other RNA
ggcgacagcgtgatcaactccgcctactac

SEQ ID NO: 14682 - RNA, 30 nt, synthetic construct
  misc_feature 1..30: note = derived and/or modified sequence opt1 from anti-influenza_CDR
  source 1..30: mol_type = other RNA
cagcagtacgacaactggctgcccatcacc

SEQ ID NO: 14683 - RNA, 30 nt, synthetic construct
  misc_feature 1..30: note = derived and/or modified sequence opt1 from anti-influenza_CDR
  source 1..30: mol_type = other RNA
gccggcgactacagcgggggcatctacgcc

SEQ ID NO: 14684 - RNA, 30 nt, synthetic construct
  misc_feature 1..30: note = derived and/or modified sequence opt1 from anti-influenza_CDR
  source 1..30: mol_type = other RNA
gccggcgactacagcgggtccaactacgcc

SEQ ID NO: 14685 - RNA, 30 nt, synthetic construct
  misc_feature 1..30: note = derived and/or modified sequence opt1 from anti-influenza_CDR
  source 1..30: mol_type = other RNA
gccggcgactacagcggggccaactacgcg

SEQ ID NO: 14686 - RNA, 30 nt, synthetic construct
  misc_feature 1..30: note = derived and/or modified sequence opt1 from anti-influenza_CDR
  source 1..30: mol_type = other RNA
ggcctgagcctctactccaacgagatcaac

SEQ ID NO: 14687 - RNA, 30 nt, synthetic construct
  misc_feature 1..30: note = derived and/or modified sequence opt1 from anti-influenza_CDR
  source 1..30: mol_type = other RNA
gccagctacgccggcaacaacatctacgtg

SEQ ID NO: 14688 - RNA, 30 nt, synthetic construct
  misc_feature 1..30: note = derived and/or modified sequence opt1 from anti-influenza_CDR
  source 1..30: mol_type = other RNA
gccagccagtccgtgagcaccttcctggcc

SEQ ID NO: 14689 - RNA, 30 nt, synthetic construct
  misc_feature 1..30: note = derived and/or modified sequence opt1 from anti-influenza_CDR
  source 1..30: mol_type = other RNA
atcaagagcaacaccgacggcgggaccacg

SEQ ID NO: 14690 - RNA, 30 nt, synthetic construct
  misc_feature 1..30: note = derived and/or modified sequence opt1 from anti-influenza_CDR
  source 1..30: mol_type = other RNA
gagagcgtggacatctacggcaactccttc

SEQ ID NO: 14691 - RNA, 30 nt, synthetic construct
  misc_feature 1..30: note = derived and/or modified sequence opt1 from anti-influenza_CDR
  source 1..30: mol_type = other RNA
gagagcatcgacatctacggcaactccttc

SEQ ID NO: 14692 - RNA, 30 nt, synthetic construct
  misc_feature 1..30: note = derived and/or modified sequence opt1 from anti-influenza_CDR
  source 1..30: mol_type = other RNA
gccggcgactacagcggggtgaactacgcc

SEQ ID NO: 14693 - RNA, 33 nt, synthetic construct
  misc_feature 1..33: note = derived and/or modified sequence opt1 from anti-influenza_CDR
  source 1..33: mol_type = other RNA
gccgcctgggacgacagcctgaacggccagctc

SEQ ID NO: 14694 - RNA, 33 nt, synthetic construct
  misc_feature 1..33: note = derived and/or modified sequence opt1 from anti-influenza_CDR
  source 1..33: mol_type = other RNA
tgcagctacgccggctccagctccagccgcgtg

SEQ ID NO: 14695 - RNA, 33 nt, synthetic construct
  misc_feature 1..33: note = derived and/or modified sequence opt1 from anti-influenza_CDR
  source 1..33: mol_type = other RNA
ctggtgctcgccaccggcctgcgcaacagcccc

SEQ ID NO: 14696 - RNA, 33 nt, synthetic construct
  misc_feature 1..33: note = derived and/or modified sequence opt1 from anti-influenza_CDR
  source 1..33: mol_type = other RNA
cagagcctgctccactccgacggcaagacctac

SEQ ID NO: 14697 - RNA, 33 nt, synthetic construct
  misc_feature 1..33: note = derived and/or modified sequence opt1 from anti-influenza_CDR
  source 1..33: mol_type = other RNA
cgcaccagccagtccctgagctcctacctccac

SEQ ID NO: 14698 - RNA, 33 nt, synthetic construct
  misc_feature 1..33: note = derived and/or modified sequence opt1 from anti-influenza_CDR
  source 1..33: mol_type = other RNA
cgcgccagccagcggctgaactcctacctccac

SEQ ID NO: 14699 - RNA, 33 nt, synthetic construct
  misc_feature 1..33: note = derived and/or modified sequence opt1 from anti-influenza_CDR
  source 1..33: mol_type = other RNA
cgcaccagccagtccctgcggagctacctccac

SEQ ID NO: 14700 - RNA, 33 nt, synthetic construct
  misc_feature 1..33: note = derived and/or modified sequence opt1 from anti-influenza_CDR
  source 1..33: mol_type = other RNA
cgcaccagccagtccctgagctcctacacccac

SEQ ID NO: 14701 - RNA, 33 nt, synthetic construct
  misc_feature 1..33: note = derived and/or modified sequence opt1 from anti-influenza_CDR
  source 1..33: mol_type = other RNA
cgcaccagccagtccctgagctcctacgaccac

SEQ ID NO: 14702 - RNA, 33 nt, synthetic construct
  misc_feature 1..33: note = derived and/or modified sequence opt1 from anti-influenza_CDR
  source 1..33: mol_type = other RNA
caggtgtgggacagctccagcgaccactacgtc

SEQ ID NO: 14703 - RNA, 33 nt, synthetic construct
  misc_feature 1..33: note = derived and/or modified sequence opt1 from anti-influenza_CDR
  source 1..33: mol_type = other RNA
caggtgtggggcagctccagcgaccactacgtc

SEQ ID NO: 14704 - RNA, 33 nt, synthetic construct
  misc_feature 1..33: note = derived and/or modified sequence opt1 from anti-influenza_CDR
  source 1..33: mol_type = other RNA
ggcacctgggacagctccctgagcgtggggatg

SEQ ID NO: 14705 - RNA, 33 nt, synthetic construct
  misc_feature 1..33: note = derived and/or modified sequence opt1 from anti-influenza_CDR
  source 1..33: mol_type = other RNA
cagagcctgctccacggcaacgggtacaactac

SEQ ID NO: 14706 - RNA, 33 nt, synthetic construct
  misc_feature 1..33: note = derived and/or modified sequence opt1 from anti-influenza_CDR
  source 1..33: mol_type = other RNA
cgcgccagccagggcatccggaacgacctgggg

SEQ ID NO: 14707 - RNA, 33 nt, synthetic construct
  misc_feature 1..33: note = derived and/or modified sequence opt1 from anti-influenza_CDR
  source 1..33: mol_type = other RNA
cgcgccagccagaacatccggtcctacctgaac

SEQ ID NO: 14708 - RNA, 33 nt, synthetic construct
  misc_feature 1..33: note = derived and/or modified sequence opt1 from anti-influenza_CDR
  source 1..33: mol_type = other RNA
cgcgccaaccaggacatcggcatctacctgaac

SEQ ID NO: 14709 - RNA, 33 nt, synthetic construct
  misc_feature 1..33: note = derived and/or modified sequence opt1 from anti-influenza_CDR
  source 1..33: mol_type = other RNA
cgcgccagccagtccgtgagcaacaacctggcc

SEQ ID NO: 14710 - RNA, 33 nt, synthetic construct
  misc_feature 1..33: note = derived and/or modified sequence opt1 from anti-influenza_CDR
  source 1..33: mol_type = other RNA
cagcagtaccacaactggcccccgagctactcc

SEQ ID NO: 14711 - RNA, 33 nt, synthetic construct
  misc_feature 1..33: note = derived and/or modified sequence opt1 from anti-influenza_CDR
  source 1..33: mol_type = other RNA
cgcgccagccagggcatcctgaactgcctcgcc

SEQ ID NO: 14712 - RNA, 33 nt, synthetic construct
  misc_feature 1..33: note = derived and/or modified sequence opt1 from anti-influenza_CDR
  source 1..33: mol_type = other RNA
cgcgccagccagtccatcgccagctggctggcg

SEQ ID NO: 14713 - RNA, 33 nt, synthetic construct
  misc_feature 1..33: note = derived and/or modified sequence opt1 from anti-influenza_CDR
  source 1..33: mol_type = other RNA
gccccccgcgtgtacgagtactacttcgaccag

SEQ ID NO: 14714 - RNA, 33 nt, synthetic construct
  misc_feature 1..33: note = derived and/or modified sequence opt1 from anti-influenza_CDR
  source 1..33: mol_type = other RNA
cgcgccagccagtccgtgagctcctacctggcc

SEQ ID NO: 14715 - RNA, 33 nt, synthetic construct
  misc_feature 1..33: note = derived and/or modified sequence opt1 from anti-influenza_CDR
  source 1..33: mol_type = other RNA
agcggcgacgccctgcccaagcagaacgcctac

SEQ ID NO: 14716 - RNA, 33 nt, synthetic construct
  misc_feature 1..33: note = derived and/or modified sequence opt1 from anti-influenza_CDR
  source 1..33: mol_type = other RNA
cagagcgccgactccagcggcacctcctgggtg

SEQ ID NO: 14717 - RNA, 33 nt, synthetic construct
  misc_feature 1..33: note = derived and/or modified sequence opt1 from anti-influenza_CDR
  source 1..33: mol_type = other RNA
ggcgggagcaacatcggcgggaagtccgtgcac

SEQ ID NO: 14718 - RNA, 33 nt, synthetic construct
  misc_feature 1..33: note = derived and/or modified sequence opt1 from anti-influenza_CDR
  source 1..33: mol_type = other RNA
cagcactacggctccagcccccgctacgccttc

SEQ ID NO: 14719 - RNA, 33 nt, synthetic construct
  misc_feature 1..33: note = derived and/or modified sequence opt1 from anti-influenza_CDR
  source 1..33: mol_type = other RNA
cgcgccagccagtccatcagctcctacctgaac

SEQ ID NO: 14720 - RNA, 33 nt, synthetic construct
  misc_feature 1..33: note = derived and/or modified sequence opt1 from anti-influenza_CDR
  source 1..33: mol_type = other RNA
ggcgggaacgccatcggcagcaagaaggtgcac

SEQ ID NO: 14721 - RNA, 33 nt, synthetic construct
  misc_feature 1..33: note = derived and/or modified sequence opt1 from anti-influenza_CDR
  source 1..33: mol_type = other RNA
caggtgtgggacttcaccatcgaccacgtcgtg

SEQ ID NO: 14722 - RNA, 33 nt, synthetic construct
  misc_feature 1..33: note = derived and/or modified sequence opt1 from anti-influenza_CDR
  source 1..33: mol_type = other RNA
gccacctgggacggcagcctgtccgcctgggtg

SEQ ID NO: 14723 - RNA, 33 nt, synthetic construct
  misc_feature 1..33: note = derived and/or modified sequence opt1 from anti-influenza_CDR
  source 1..33: mol_type = other RNA
cgcgccagccagtccgtgggcaactacctggcc

SEQ ID NO: 14724 - RNA, 33 nt, synthetic construct
  misc_feature 1..33: note = derived and/or modified sequence opt1 from anti-influenza_CDR
  source 1..33: mol_type = other RNA
cagcagcgcagcaagtggcccccgatgtactcc

SEQ ID NO: 14725 - RNA, 33 nt, synthetic construct
  misc_feature 1..33: note = derived and/or modified sequence opt1 from anti-influenza_CDR
  source 1..33: mol_type = other RNA
gacgtgagcaccacctggtcctggttcgccccc

SEQ ID NO: 14726 - RNA, 33 nt, synthetic construct
  misc_feature 1..33: note = derived and/or modified sequence opt1 from anti-influenza_CDR
  source 1..33: mol_type = other RNA
cgcgccagccagaacatcaagcggtacttcaac

SEQ ID NO: 14727 - RNA, 33 nt, synthetic construct
  misc_feature 1..33: note = derived and/or modified sequence opt1 from anti-influenza_CDR
  source 1..33: mol_type = other RNA
cgcgccagccagtccgtgggcaacagcctggcc

SEQ ID NO: 14728 - RNA, 33 nt, synthetic construct
  misc_feature 1..33: note = derived and/or modified sequence opt1 from anti-influenza_CDR
  source 1..33: mol_type = other RNA
ggcgagagcaccctgtcctactacgccgtgagc

SEQ ID NO: 14729 - RNA, 33 nt, synthetic construct
  misc_feature 1..33: note = derived and/or modified sequence opt1 from anti-influenza_CDR
  source 1..33: mol_type = other RNA
cgcgccagccagaacatctacaagtacctgaac

SEQ ID NO: 14730 - RNA, 33 nt, synthetic construct
  misc_feature 1..33: note = derived and/or modified sequence opt1 from anti-influenza_CDR
  source 1..33: mol_type = other RNA
gccagctgctccggcgggtactgcatcctggac

SEQ ID NO: 14731 - RNA, 33 nt, synthetic construct
  misc_feature 1..33: note = derived and/or modified sequence opt1 from anti-influenza_CDR
  source 1..33: mol_type = other RNA
cgcaccagccagtccatcagctcctacctgaac

SEQ ID NO: 14732 - RNA, 33 nt, synthetic construct
  misc_feature 1..33: note = derived and/or modified sequence opt1 from anti-influenza_CDR
  source 1..33: mol_type = other RNA
cgcgccagccagtccatcggcgcctacgtgaac

SEQ ID NO: 14733 - RNA, 33 nt, synthetic construct
  misc_feature 1..33: note = derived and/or modified sequence opt1 from anti-influenza_CDR
  source 1..33: mol_type = other RNA
cgcgccagccagtccatcagcacctacctgaac

SEQ ID NO: 14734 - RNA, 33 nt, synthetic construct
  misc_feature 1..33: note = derived and/or modified sequence opt1 from anti-influenza_CDR
  source 1..33: mol_type = other RNA
cgcgccagccagtccatcgacaagttcctgaac

SEQ ID NO: 14735 - RNA, 33 nt, synthetic construct
  misc_feature 1..33: note = derived and/or modified sequence opt1 from anti-influenza_CDR
  source 1..33: mol_type = other RNA
ggcgggcacaacatcggcagcaactccgtgcac

SEQ ID NO: 14736 - RNA, 33 nt, synthetic construct
  misc_feature 1..33: note = derived and/or modified sequence opt1 from anti-influenza_CDR
  source 1..33: mol_type = other RNA
cgcgccagccagtccatcagcacctacctgcac

SEQ ID NO: 14737 - RNA, 33 nt, synthetic construct
  misc_feature 1..33: note = derived and/or modified sequence opt1 from anti-influenza_CDR
  source 1..33: mol_type = other RNA
cacgtgggcgggcacacctacggcatcgactac

SEQ ID NO: 14738 - RNA, 33 nt, synthetic construct
  misc_feature 1..33: note = derived and/or modified sequence opt1 from anti-influenza_CDR
  source 1..33: mol_type = other RNA
cgcgccagccagtccatcagcaactacctgaac

SEQ ID NO: 14739 - RNA, 33 nt, synthetic construct
  misc_feature 1..33: note = derived and/or modified sequence opt1 from anti-influenza_CDR
  source 1..33: mol_type = other RNA
cacgacgacgccagccacggctactccatcagc

SEQ ID NO: 14740 - RNA, 33 nt, synthetic construct
  misc_feature 1..33: note = derived and/or modified sequence opt1 from anti-influenza_CDR
  source 1..33: mol_type = other RNA
cgcgccagccagaccatctccacctacctgaac

SEQ ID NO: 14741 - RNA, 33 nt, synthetic construct
  misc_feature 1..33: note = derived and/or modified sequence opt1 from anti-influenza_CDR
  source 1..33: mol_type = other RNA
cgcgccagccagtccatcagccggtacctgaac

SEQ ID NO: 14742 - RNA, 33 nt, synthetic construct
  misc_feature 1..33: note = derived and/or modified sequence opt1 from anti-influenza_CDR
  source 1..33: mol_type = other RNA
ggcacctgggacagctccctgagcgcctacgtg

SEQ ID NO: 14743 - RNA, 33 nt, synthetic construct
  misc_feature 1..33: note = derived and/or modified sequence opt1 from anti-influenza_CDR
  source 1..33: mol_type = other RNA
agctccaactactacgacagcgtgtacgactac

SEQ ID NO: 14744 - RNA, 33 nt, synthetic construct
  misc_feature 1..33: note = derived and/or modified sequence opt1 from anti-influenza_CDR
  source 1..33: mol_type = other RNA
gccgcctgggacgacatcctgaacgtgcccgtc

SEQ ID NO: 14745 - RNA, 33 nt, synthetic construct
  misc_feature 1..33: note = derived and/or modified sequence opt1 from anti-influenza_CDR
  source 1..33: mol_type = other RNA
gtggcctgggacgacagcgtcgacggctacgtg

SEQ ID NO: 14746 - RNA, 33 nt, synthetic construct
  misc_feature 1..33: note = derived and/or modified sequence opt1 from anti-influenza_CDR
  source 1..33: mol_type = other RNA
ggccccaagtactacagcgagtacatggacgtg

SEQ ID NO: 14747 - RNA, 33 nt, synthetic construct
  misc_feature 1..33: note = derived and/or modified sequence opt1 from anti-influenza_CDR
  source 1..33: mol_type = other RNA
cgcgccagccagggcatctccagctacctggcc

SEQ ID NO: 14748 - RNA, 33 nt, synthetic construct
  misc_feature 1..33: note = derived and/or modified sequence opt1 from anti-influenza_CDR
  source 1..33: mol_type = other RNA
agctccggctactaccccgagtacttccaggac

SEQ ID NO: 14749 - RNA, 33 nt, synthetic construct
  misc_feature 1..33: note = derived and/or modified sequence opt1 from anti-influenza_CDR
  source 1..33: mol_type = other RNA
agcggccacaagctgggggacaagtacgtgtcc

SEQ ID NO: 14750 - RNA, 33 nt, synthetic construct
  misc_feature 1..33: note = derived and/or modified sequence opt1 from anti-influenza_CDR
  source 1..33: mol_type = other RNA
agcaccggctactaccccgcctacctgcaccac

SEQ ID NO: 14751 - RNA, 33 nt, synthetic construct
  misc_feature 1..33: note = derived and/or modified sequence opt1 from anti-influenza_CDR
  source 1..33: mol_type = other RNA
cgcgccagccagcgggtgtccagctacctggcc

SEQ ID NO: 14752 - RNA, 33 nt, synthetic construct; identical to SEQ ID NO: 13645
  misc_feature 1..33: note = derived and/or modified sequence opt1 from anti-influenza_CDR
  source 1..33: mol_type = other RNA

SEQ ID NO: 14753 - RNA, 33 nt, synthetic construct
  misc_feature 1..33: note = derived and/or modified sequence opt1 from anti-influenza_CDR
  source 1..33: mol_type = other RNA
caggtgtgggacagctccagcgaccacgccgtc

SEQ ID NO: 14754 - RNA, 33 nt, synthetic construct
  misc_feature 1..33: note = derived and/or modified sequence opt1 from anti-influenza_CDR
  source 1..33: mol_type = other RNA
gccacctgggacgacaacctgagcggccccgtg

SEQ ID NO: 14755 - RNA, 33 nt, synthetic construct
  misc_feature 1..33: note = derived and/or modified sequence opt1 from anti-influenza_CDR
  source 1..33: mol_type = other RNA
agctccggctactaccccgcctacctgccgcac

SEQ ID NO: 14756 - RNA, 33 nt, synthetic construct
  misc_feature 1..33: note = derived and/or modified sequence opt1 from anti-influenza_CDR
  source 1..33: mol_type = other RNA
ggcgggaacaacatcggcagcaagggggtgcac

SEQ ID NO: 14757 - RNA, 33 nt, synthetic construct
  misc_feature 1..33: note = derived and/or modified sequence opt1 from anti-influenza_CDR
  source 1..33: mol_type = other RNA
caggtgtgggacagctccagcgaccacgtcgtg

SEQ ID NO: 14758 - RNA, 33 nt, synthetic construct
  misc_feature 1..33: note = derived and/or modified sequence opt1 from anti-influenza_CDR
  source 1..33: mol_type = other RNA
ggcaactactactacgagagctccctggactac

SEQ ID NO: 14759 - RNA, 33 nt, synthetic construct
  misc_feature 1..33: note = derived and/or modified sequence opt1 from anti-influenza_CDR
  source 1..33: mol_type = other RNA
ggcccccactactacagctcctacatggacgtg

SEQ ID NO: 14760 - RNA, 33 nt, synthetic construct
  misc_feature 1..33: note = derived and/or modified sequence opt1 from anti-influenza_CDR
  source 1..33: mol_type = other RNA
cgcgccagccagggcatctccacctacctggcc

SEQ ID NO: 14761 - RNA, 33 nt, synthetic construct
  misc_feature 1..33: note = derived and/or modified sequence opt1 from anti-influenza_CDR
  source 1..33: mol_type = other RNA
ggccccacctactactacagctacatggacgtg

SEQ ID NO: 14762 - RNA, 33 nt, synthetic construct
  misc_feature 1..33: note = derived and/or modified sequence opt1 from anti-influenza_CDR
  source 1..33: mol_type = other RNA
ggcgggaacaacatcggccgcaacagcgtgcac

SEQ ID NO: 14763 - RNA, 33 nt, synthetic construct
  misc_feature 1..33: note = derived and/or modified sequence opt1 from anti-influenza_CDR
  source 1..33: mol_type = other RNA
caggtgtggcacagctccagcgaccactacgtc

SEQ ID NO: 14764 - RNA, 33 nt, synthetic construct
  misc_feature 1..33: note = derived and/or modified sequence opt1 from anti-influenza_CDR
  source 1..33: mol_type = other RNA
agctccggctactacccccagtacttccaggac

SEQ ID NO: 14765 - RNA, 33 nt, synthetic construct
  misc_feature 1..33: note = derived and/or modified sequence opt1 from anti-influenza_CDR
  source 1..33: mol_type = other RNA
cgcgccagccagtccgtgagccggtacctggcc

SEQ ID NO: 14766 - RNA, 33 nt, synthetic construct
  misc_feature 1..33: note = derived and/or modified sequence opt1 from anti-influenza_CDR
  source 1..33: mol_type = other RNA
tggggccaggggaccaccctgacggtgagctcc

SEQ ID NO: 14767 - RNA, 33 nt, synthetic construct
  misc_feature 1..33: note = derived and/or modified sequence opt1 from anti-influenza_CDR
  source 1..33: mol_type = other RNA
cgcgccagccagtccgtggacagcaacctggcc

SEQ ID NO: 14768 - RNA, 33 nt, synthetic construct
  misc_feature 1..33: note = derived and/or modified sequence opt1 from anti-influenza_CDR
  source 1..33: mol_type = other RNA
cgcgccagccagtccgtgagccacaacctggcc

SEQ ID NO: 14769 - RNA, 33 nt, synthetic construct
  misc_feature 1..33: note = derived and/or modified sequence opt1 from anti-influenza_CDR
  source 1..33: mol_type = other RNA
cgcgccagccagtccgtgagctccaacctggcc

SEQ ID NO: 14770 - RNA, 33 nt, synthetic construct
  misc_feature 1..33: note = derived and/or modified sequence opt1 from anti-influenza_CDR
  source 1..33: mol_type = other RNA
cgcgccagccagtccgtggaccacaacctggcc

SEQ ID NO: 14771 - RNA, 33 nt, synthetic construct
  misc_feature 1..33: note = derived and/or modified sequence opt1 from anti-influenza_CDR
  source 1..33: mol_type = other RNA
cagcactacaccaactggcccccgcgcctgacc

SEQ ID NO: 14772 - RNA, 33 nt, synthetic construct
  misc_feature 1..33: note = derived and/or modified sequence opt1 from anti-influenza_CDR
  source 1..33: mol_type = other RNA
cagcactacaccaactacccgccccgcctgacc

SEQ ID NO: 14773 - RNA, 33 nt, synthetic construct
  misc_feature 1..33: note = derived and/or modified sequence opt1 from anti-influenza_CDR
  source 1..33: mol_type = other RNA
cagcactacaccaacttcccgccccgcctgacc

SEQ ID NO: 14774 - RNA, 33 nt, synthetic construct
  misc_feature 1..33: note = derived and/or modified sequence opt1 from anti-influenza_CDR
  source 1..33: mol_type = other RNA
cgcgccagccaggtgatctcccacaacctggcc

SEQ ID NO: 14775 - RNA, 33 nt, synthetic construct
  misc_feature 1..33: note = derived and/or modified sequence opt1 from anti-influenza_CDR
  source 1..33: mol_type = other RNA
cagcactacagcaactggcccccgcgcctgacc

SEQ ID NO: 14776 - RNA, 33 nt, synthetic construct
  misc_feature 1..33: note = derived and/or modified sequence opt1 from anti-influenza_CDR
  source 1..33: mol_type = other RNA
cagcactacagcaacttcccgccccgcctgacc

SEQ ID NO: 14777 - RNA, 33 nt, synthetic construct
  misc_feature 1..33: note = derived and/or modified sequence opt1 from anti-influenza_CDR
  source 1..33: mol_type = other RNA
cagcactacagcaactacccgccccgcctgacc

SEQ ID NO: 14778 - RNA, 33 nt, synthetic construct
  misc_feature 1..33: note = derived and/or modified sequence opt1 from anti-influenza_CDR
  source 1..33: mol_type = other RNA
cgcgccagccagtccgtggccaacaacctggcg

SEQ ID NO: 14779 - RNA, 33 nt, synthetic construct
  misc_feature 1..33: note = derived and/or modified sequence opt1 from anti-influenza_CDR
  source 1..33: mol_type = other RNA
cagcagtacaacaactggcccccgatgtacacc

SEQ ID NO: 14780 - RNA, 33 nt, synthetic construct
  misc_feature 1..33: note = derived and/or modified sequence opt1 from anti-influenza_CDR
  source 1..33: mol_type = other RNA
cgcgccagccagtccatcggcaactggctggcc

SEQ ID NO: 14781 - RNA, 33 nt, synthetic construct
  misc_feature 1..33: note = derived and/or modified sequence opt1 from anti-influenza_CDR
  source 1..33: mol_type = other RNA
cagcgctacaccagcaactcccagggcttcacc

SEQ ID NO: 14782 - RNA, 33 nt, synthetic construct
  misc_feature 1..33: note = derived and/or modified sequence opt1 from anti-influenza_CDR
  source 1..33: mol_type = other RNA
gccgcctgggacgacaccctgaacggccccgtg

SEQ ID NO: 14783 - RNA, 33 nt, synthetic construct
  misc_feature 1..33: note = derived and/or modified sequence opt1 from anti-influenza_CDR
  source 1..33: mol_type = other RNA
aaggccagccagaacgtgggctccaacgtcgcc

SEQ ID NO: 14784 - RNA, 33 nt, synthetic construct
  misc_feature 1..33: note = derived and/or modified sequence opt1 from anti-influenza_CDR
  source 1..33: mol_type = other RNA
caggtgtgggacatgagctccgaccgccgggtc

SEQ ID NO: 14785 - RNA, 33 nt, synthetic construct
  misc_feature 1..33: note = derived and/or modified sequence opt1 from anti-influenza_CDR
  source 1..33: mol_type = other RNA
cagagcctgctccactccaacggctacaactac

SEQ ID NO: 14786 - RNA, 33 nt, synthetic construct
  misc_feature 1..33: note = derived and/or modified sequence opt1 from anti-influenza_CDR
  source 1..33: mol_type = other RNA
acctacctggtgggcgccgtcgggttccagcac

SEQ ID NO: 14787 - RNA, 33 nt, synthetic construct; identical to SEQ ID NO: 13698
  misc_feature 1..33: note = derived and/or modified sequence opt1 from anti-influenza_CDR
  source 1..33: mol_type = other RNA

SEQ ID NO: 14788 - RNA, 33 nt, synthetic construct
  misc_feature 1..33: note = derived and/or modified sequence opt1 from anti-influenza_CDR
  source 1..33: mol_type = other RNA
cagagcctgctcgactccaacggctacaactac

SEQ ID NO: 14789 - RNA, 33 nt, synthetic construct
  misc_feature 1..33: note = derived and/or modified sequence opt1 from anti-influenza_CDR
  source 1..33: mol_type = other RNA
atgcaggccctgcagaccccgcccatgtacacc

SEQ ID NO: 14790 - RNA, 33 nt, synthetic construct
  misc_feature 1..33: note = derived and/or modified sequence opt1 from anti-influenza_CDR
  source 1..33: mol_type = other RNA
cagagcctgctccactccaacggctacaaccac

SEQ ID NO: 14791 - RNA, 33 nt, synthetic construct
  misc_feature 1..33: note = derived and/or modified sequence opt1 from anti-influenza_CDR
  source 1..33: mol_type = other RNA
caggtgtgggacatcaccagcgacctggtcgtg

SEQ ID NO: 14792 - RNA, 33 nt, synthetic construct
  misc_feature 1..33: note = derived and/or modified sequence opt1 from anti-influenza_CDR
  source 1..33: mol_type = other RNA
cgcgccagccaggacatctccacctggctggcc

SEQ ID NO: 14793 - RNA, 33 nt, synthetic construct
  misc_feature 1..33: note = derived and/or modified sequence opt1 from anti-influenza_CDR
  source 1..33: mol_type = other RNA
cgcgccagccggtccatcaccaccttcctggcc

SEQ ID NO: 14794 - RNA, 33 nt, synthetic construct
  misc_feature 1..33: note = derived and/or modified sequence opt1 from anti-influenza_CDR
  source 1..33: mol_type = other RNA
gggtggggcgccgtgaccagccccttcgacttc

SEQ ID NO: 14795 - RNA, 33 nt, synthetic construct
  misc_feature 1..33: note = derived and/or modified sequence opt1 from anti-influenza_CDR
  source 1..33: mol_type = other RNA
cgcgccagccagtccgtgagctccagctacctg

SEQ ID NO: 14796 - RNA, 36 nt, synthetic construct
  misc_feature 1..36: note = derived and/or modified sequence opt1 from anti-influenza_CDR
  source 1..36: mol_type = other RNA
cagagcgtgctgtactccagcaacaacaagaactac

SEQ ID NO: 14797 - RNA, 36 nt, synthetic construct
  misc_feature 1..36: note = derived and/or modified sequence opt1 from anti-influenza_CDR
  source 1..36: mol_type = other RNA
gccgcctgggacgacagcctgtccggcagctgggtg

SEQ ID NO: 14798 - RNA, 36 nt, synthetic construct
  misc_feature 1..36: note = derived and/or modified sequence opt1 from anti-influenza_CDR
  source 1..36: mol_type = other RNA
gtgttctacagcgccgaccgcacctcctacgccgac

SEQ ID NO: 14799 - RNA, 36 nt, synthetic construct
  misc_feature 1..36: note = derived and/or modified sequence opt1 from anti-influenza_CDR
  source 1..36: mol_type = other RNA
cgcgtgggccagagcgtctccgggagccacctggcc

SEQ ID NO: 14800 - RNA, 36 nt, synthetic construct
  misc_feature 1..36: note = derived and/or modified sequence opt1 from anti-influenza_CDR
  source 1..36: mol_type = other RNA
accctgagctccgcctacagcaactacaaggtggac

SEQ ID NO: 14801 - RNA, 36 nt, synthetic construct
  misc_feature 1..36: note = derived and/or modified sequence opt1 from anti-influenza_CDR
  source 1..36: mol_type = other RNA
gtgggcaccgggggcatcgtcgggagcaagggcgac

SEQ ID NO: 14802 - RNA, 36 nt, synthetic construct
  misc_feature 1..36: note = derived and/or modified sequence opt1 from anti-influenza_CDR
  source 1..36: mol_type = other RNA
cgctacagccggtccagccccggcaccttcgagtcc

SEQ ID NO: 14803 - RNA, 36 nt, synthetic construct
  misc_feature 1..36: note = derived and/or modified sequence opt1 from anti-influenza_CDR
  source 1..36: mol_type = other RNA
cagagctacgactccagcctgtccggcttccacgtg

SEQ ID NO: 14804 - RNA, 36 nt, synthetic construct
  misc_feature 1..36: note = derived and/or modified sequence opt1 from anti-influenza_CDR
  source 1..36: mol_type = other RNA
cgcgccagccagtccgtgagctccagccagctggcc

SEQ ID NO: 14805 - RNA, 36 nt, synthetic construct
  misc_feature 1..36: note = derived and/or modified sequence opt1 from anti-influenza_CDR
  source 1..36: mol_type = other RNA
cgcgccagccagttcgtgtccacccggagcctggcc

SEQ ID NO: 14806 - RNA, 36 nt, synthetic construct
  misc_feature 1..36: note = derived and/or modified sequence opt1 from anti-influenza_CDR
  source 1..36: mol_type = other RNA
gccacctgggacgacagcctgaacggcttctacgtg

SEQ ID NO: 14807 - RNA, 36 nt, synthetic construct
  misc_feature 1..36: note = derived and/or modified sequence opt1 from anti-influenza_CDR
  source 1..36: mol_type = other RNA
cgcgccagccacttcgtgaactaccggtccctggcc

SEQ ID NO: 14808 - RNA, 36 nt, synthetic construct
  misc_feature 1..36: note = derived and/or modified sequence opt1 from anti-influenza_CDR
  source 1..36: mol_type = other RNA
cgcgccagccacttcgtgatcggccgggccgtcgcg

SEQ ID NO: 14809 - RNA, 36 nt, synthetic construct
  misc_feature 1..36: note = derived and/or modified sequence opt1 from anti-influenza_CDR
  source 1..36: mol_type = other RNA
cgcatctaccacggcgggaacagcggcttcgacttc

SEQ ID NO: 14810 - RNA, 36 nt, synthetic construct
  misc_feature 1..36: note = derived and/or modified sequence opt1 from anti-influenza_CDR
  source 1..36: mol_type = other RNA
accctgagctccggcttcgacaactaccaggtggcc

SEQ ID NO: 14811 - RNA, 36 nt, synthetic construct
  misc_feature 1..36: note = derived and/or modified sequence opt1 from anti-influenza_CDR
  source 1..36: mol_type = other RNA
gtgggcaacgggggcaacgtcgccagcaagggggac

SEQ ID NO: 14812 - RNA, 36 nt, synthetic construct
  misc_feature 1..36: note = derived and/or modified sequence opt1 from anti-influenza_CDR
  source 1..36: mol_type = other RNA
gtgcgcggcgggagcaccgtcgcctacttcggcgtg

SEQ ID NO: 14813 - RNA, 36 nt, synthetic construct
  misc_feature 1..36: note = derived and/or modified sequence opt1 from anti-influenza_CDR
  source 1..36: mol_type = other RNA
tgcctgagccgcatgcggggctacgggctcgacgtg

SEQ ID NO: 14814 - RNA, 36 nt, synthetic construct
  misc_feature 1..36: note = derived and/or modified sequence opt1 from anti-influenza_CDR
  source 1..36: mol_type = other RNA
gtgggccagatggacaagtactacgccatggacgtc

SEQ ID NO: 14815 - RNA, 36 nt, synthetic construct
  misc_feature 1..36: note = derived and/or modified sequence opt1 from anti-influenza_CDR
  source 1..36: mol_type = other RNA
ggcgtgaccaacaaggtcaacagcatcatcgacaag

SEQ ID NO: 14816 - RNA, 36 nt, synthetic construct
  misc_feature 1..36: note = derived and/or modified sequence opt1 from anti-influenza_CDR
  source 1..36: mol_type = other RNA
ggcgtgaccaacaaggtcaaccgcatcatcgacaag

SEQ ID NO: 14817 - RNA, 36 nt, synthetic construct
  misc_feature 1..36: note = derived and/or modified sequence opt1 from anti-influenza_CDR
  source 1..36: mol_type = other RNA
ggcgtgaccaacaaggagaacagcatcatcgacaag

SEQ ID NO: 14818 - RNA, 36 nt, synthetic construct
  misc_feature 1..36: note = derived and/or modified sequence opt1 from anti-influenza_CDR
  source 1..36: mol_type = other RNA
cccctgggcatcctccactactacgccatggacctg

SEQ ID NO: 14819 - RNA, 36 nt, synthetic construct
  misc_feature 1..36: note = derived and/or modified sequence opt1 from anti-influenza_CDR
  source 1..36: mol_type = other RNA
aagatcaccagcaaggtgaacaacatcgtcgacaag

SEQ ID NO: 14820 - RNA, 36 nt, synthetic construct
  misc_feature 1..36: note = derived and/or modified sequence opt1 from anti-influenza_CDR
  source 1..36: mol_type = other RNA
ggcatcaccaacaaggtgaacagcatcatcgacaag

SEQ ID NO: 14821 - RNA, 36 nt, synthetic construct
  misc_feature 1..36: note = derived and/or modified sequence opt1 from anti-influenza_CDR
  source 1..36: mol_type = other RNA
aacggccgcagctccaccagctgggggatcgacgtg

SEQ ID NO: 14822 - RNA, 36 nt, synthetic construct
  misc_feature 1..36: note = derived and/or modified sequence opt1 from anti-influenza_CDR
  source 1..36: mol_type = other RNA
ggcatcaccaacaaggagaacagcgtgatcgagaag

SEQ ID NO: 14823 - RNA, 36 nt, synthetic construct
  misc_feature 1..36: note = derived and/or modified sequence opt1 from anti-influenza_CDR
  source 1..36: mol_type = other RNA
cccctgggcagccgctactactacgggatggacgtg

SEQ ID NO: 14824 - RNA, 36 nt, synthetic construct
  misc_feature 1..36: note = derived and/or modified sequence opt1 from anti-influenza_CDR
  source 1..36: mol_type = other RNA
ggcatcaccaacaaggtgaacagcgtcatcgagaag

SEQ ID NO: 14825 - RNA, 36 nt, synthetic construct
  misc_feature 1..36: note = derived and/or modified sequence opt1 from anti-influenza_CDR
  source 1..36: mol_type = other RNA
ggcgtgaccaacaaggtcaacagcatcatcaacaag

SEQ ID NO: 14826 - RNA, 36 nt, synthetic construct
  misc_feature 1..36: note = derived and/or modified sequence opt1 from anti-influenza_CDR
  source 1..36: mol_type = other RNA
cacatgggctaccaggtgcgcgagaccatggacgtc

SEQ ID NO: 14827 - RNA, 36 nt, synthetic construct
  misc_feature 1..36: note = derived and/or modified sequence opt1 from anti-influenza_CDR
  source 1..36: mol_type = other RNA
gccacctgggaccgccggcccaccgcctacgtggtc

SEQ ID NO: 14828 - RNA, 36 nt, synthetic construct
  misc_feature 1..36: note = derived and/or modified sequence opt1 from anti-influenza_CDR
  source 1..36: mol_type = other RNA
gagggcaagtgggggccccaggccgccttcgacatc

SEQ ID NO: 14829 - RNA, 36 nt, synthetic construct
  misc_feature 1..36: note = derived and/or modified sequence opt1 from anti-influenza_CDR
  source 1..36: mol_type = other RNA
ggcgacaaggggatctactactactacatggacgtg

SEQ ID NO: 14830 - RNA, 36 nt, synthetic construct
  misc_feature 1..36: note = derived and/or modified sequence opt1 from anti-influenza_CDR
  source 1..36: mol_type = other RNA
ggcagcgggtaccacatctccacccccttcgacaac

SEQ ID NO: 14831 - RNA, 36 nt, synthetic construct
  misc_feature 1..36: note = derived and/or modified sequence opt1 from anti-influenza_CDR
  source 1..36: mol_type = other RNA
cgcgccagccagtccgtgagctccagctacctggcc

SEQ ID NO: 14832 - RNA, 36 nt, synthetic construct
  misc_feature 1..36: note = derived and/or modified sequence opt1 from anti-influenza_CDR
  source 1..36: mol_type = other RNA
ggcagcgggtacaccacccgcaactacttcgactac

SEQ ID NO: 14833 - RNA, 36 nt, synthetic construct
  misc_feature 1..36: note = derived and/or modified sequence opt1 from anti-influenza_CDR
  source 1..36: mol_type = other RNA
cgcgccagccagtccgtgagctccaactacctgggc

SEQ ID NO: 14834 - RNA, 36 nt, synthetic construct
  misc_feature 1..36: note = derived and/or modified sequence opt1 from anti-influenza_CDR
  source 1..36: mol_type = other RNA
ggcagcacctacgacttctccagcgggctggactac

SEQ ID NO: 14835 - RNA, 36 nt, synthetic construct
  misc_feature 1..36: note = derived and/or modified sequence opt1 from anti-influenza_CDR
  source 1..36: mol_type = other RNA
ggcgtgcaccaccccgggaccgacaacgaccagatc

SEQ ID NO: 14836 - RNA, 36 nt, synthetic construct
  misc_feature 1..36: note = derived and/or modified sequence opt1 from anti-influenza_CDR
  source 1..36: mol_type = other RNA
ggcgtgcaccaccccagcaccgactccgaccagacc

SEQ ID NO: 14837 - RNA, 36 nt, synthetic construct
  misc_feature 1..36: note = derived and/or modified sequence opt1 from anti-influenza_CDR
  source 1..36: mol_type = other RNA
ggcgtgcaccaccccagcaacgagaccgagcagcgc

SEQ ID NO: 14838 - RNA, 36 nt, synthetic construct
  misc_feature 1..36: note = derived and/or modified sequence opt1 from anti-influenza_CDR
  source 1..36: mol_type = other RNA
cagagcatcaccttcgactacaagaactacctggcc

SEQ ID NO: 14839 - RNA, 36 nt, synthetic construct
  misc_feature 1..36: note = derived and/or modified sequence opt1 from anti-influenza_CDR
  source 1..36: mol_type = other RNA
ggcgggctgatcggcaccgggagctactactggggc

SEQ ID NO: 14840 - RNA, 36 nt, synthetic construct
  misc_feature 1..36: note = derived and/or modified sequence opt1 from anti-influenza_CDR
  source 1..36: mol_type = other RNA
gcccgctacaactggggcatccggtacttcgacttc

SEQ ID NO: 14841 - RNA, 36 nt, synthetic construct
  misc_feature 1..36: note = derived and/or modified sequence opt1 from anti-influenza_CDR
  source 1..36: mol_type = other RNA
cagagcgtgctgtccaacagcaagaacctcaactac

SEQ ID NO: 14842 - RNA, 36 nt, synthetic construct
  misc_feature 1..36: note = derived and/or modified sequence opt1 from anti-influenza_CDR
  source 1..36: mol_type = other RNA
tgccaggtgtgggagaccagcgaggacctgtgggtc

SEQ ID NO: 14843 - RNA, 39 nt, synthetic construct
  misc_feature 1..39: note = derived and/or modified sequence opt1 from anti-influenza_CDR
  source 1..39: mol_type = other RNA
gcccgcggcgggcggtactacgtggactacttcgactac

SEQ ID NO: 14844 - RNA, 39 nt, synthetic construct
  misc_feature 1..39: note = derived and/or modified sequence opt1 from anti-influenza_CDR
  source 1..39: mol_type = other RNA
gcccgcagcggcgacgggtacaactactacttccccctg

SEQ ID NO: 14845 - RNA, 39 nt, synthetic construct
  misc_feature 1..39: note = derived and/or modified sequence opt1 from anti-influenza_CDR
  source 1..39: mol_type = other RNA
gcccgcggctgcgggtacaactgctactacttcgacggc

SEQ ID NO: 14846 - RNA, 39 nt, synthetic construct
  misc_feature 1..39: note = derived and/or modified sequence opt1 from anti-influenza_CDR
  source 1..39: mol_type = other RNA
agcggctccagctccaacatcgggagcaacaccgtgaac

SEQ ID NO: 14847 - RNA, 39 nt, synthetic construct
  misc_feature 1..39: note = derived and/or modified sequence opt1 from anti-influenza_CDR
  source 1..39: mol_type = other RNA
gacagcccctactccagctcctggagcttcttcgactac

SEQ ID NO: 14848 - RNA, 39 nt, synthetic construct
  misc_feature 1..39: note = derived and/or modified sequence opt1 from anti-influenza_CDR
  source 1..39: mol_type = other RNA
agcggctccgacagcaacatcggggactacttcgtgtgc

SEQ ID NO: 14849 - RNA, 39 nt, synthetic construct
  misc_feature 1..39: note = derived and/or modified sequence opt1 from anti-influenza_CDR
  source 1..39: mol_type = other RNA
gcccgcatggtggtcgtgaccggcgacgggttcgacgtg

SEQ ID NO: 14850 - RNA, 39 nt, synthetic construct
  misc_feature 1..39: note = derived and/or modified sequence opt1 from anti-influenza_CDR
  source 1..39: mol_type = other RNA
tggctgagcatcatcaacgccggcgggggcgacatcgac

SEQ ID NO: 14851 - RNA, 39 nt, synthetic construct
  misc_feature 1..39: note = derived and/or modified sequence opt1 from anti-influenza_CDR
  source 1..39: mol_type = other RNA
gccgccagctccctgcagagcggcgtgccctcccgcttc

SEQ ID NO: 14852 - RNA, 39 nt, synthetic construct
  misc_feature 1..39: note = derived and/or modified sequence opt1 from anti-influenza_CDR
  source 1..39: mol_type = other RNA
cacgacgccaagttcagcggctcctactacgtggccagc

SEQ ID NO: 14853 - RNA, 39 nt, synthetic construct
  misc_feature 1..39: note = derived and/or modified sequence opt1 from anti-influenza_CDR
  source 1..39: mol_type = other RNA
cacgacgtgaagttcagcggctcctactacgtcgccagc

SEQ ID NO: 14854 - RNA, 39 nt, synthetic construct
  misc_feature 1..39: note = derived and/or modified sequence opt1 from anti-influenza_CDR
  source 1..39: mol_type = other RNA
accggcagcgagtccaccacggggtacggcatggacgtg

SEQ ID NO: 14855 - RNA, 39 nt, synthetic construct
  misc_feature 1..39: note = derived and/or modified sequence opt1 from anti-influenza_CDR
  source 1..39: mol_type = other RNA
gccgccagcacctccgtgctgggctacgggatggacgtc

SEQ ID NO: 14856 - RNA, 39 nt, synthetic construct
  misc_feature 1..39: note = derived and/or modified sequence opt1 from anti-influenza_CDR
  source 1..39: mol_type = other RNA
agcggctccaccttcaacatcgggagcaacgccgtggac

SEQ ID NO: 14857 - RNA, 39 nt, synthetic construct
  misc_feature 1..39: note = derived and/or modified sequence opt1 from anti-influenza_CDR
  source 1..39: mol_type = other RNA
agcggctcccgcagcaacgtgggggacaactccgtctac

SEQ ID NO: 14858 - RNA, 39 nt, synthetic construct
  misc_feature 1..39: note = derived and/or modified sequence opt1 from anti-influenza_CDR
  source 1..39: mol_type = other RNA
agcggctccagctccaacatcgggaacgactacgtgagc

SEQ ID NO: 14859 - RNA, 39 nt, synthetic construct
  misc_feature 1..39: note = derived and/or modified sequence opt1 from anti-influenza_CDR
  source 1..39: mol_type = other RNA
ggcgggggcagctacggggcctacgagggcttcgactac

SEQ ID NO: 14860 - RNA, 39 nt, synthetic construct
  misc_feature 1..39: note = derived and/or modified sequence opt1 from anti-influenza_CDR
  source 1..39: mol_type = other RNA
agcggctccagctccaacatcgggagcaactacgtgtac

SEQ ID NO: 14861 - RNA, 39 nt, synthetic construct
  misc_feature 1..39: note = derived and/or modified sequence opt1 from anti-influenza_CDR
  source 1..39: mol_type = other RNA
gcccgccggcagcagctgtacaagggctactaccaccac

SEQ ID NO: 14862 - RNA, 39 nt, synthetic construct
  misc_feature 1..39: note = derived and/or modified sequence opt1 from anti-influenza_CDR
  source 1..39: mol_type = other RNA
agcggctccaccagcaacatcgggtacaaccccgtgtcc

SEQ ID NO: 14863 - RNA, 39 nt, synthetic construct
  misc_feature 1..39: note = derived and/or modified sequence opt1 from anti-influenza_CDR
  source 1..39: mol_type = other RNA
gcccgcggcatgaactactacagcgactacttcgactac

SEQ ID NO: 14864 - RNA, 39 nt, synthetic construct
  misc_feature 1..39: note = derived and/or modified sequence opt1 from anti-influenza_CDR
  source 1..39: mol_type = other RNA
gcccgcggccacagcgggtcctaccggctgttcgacttc

SEQ ID NO: 14865 - RNA, 39 nt, synthetic construct
  misc_feature 1..39: note = derived and/or modified sequence opt1 from anti-influenza_CDR
  source 1..39: mol_type = other RNA
gccaagcccctgcgcggcagctaccggtacttcgacctc

SEQ ID NO: 14866 - RNA, 39 nt, synthetic construct
  misc_feature 1..39: note = derived and/or modified sequence opt1 from anti-influenza_CDR
  source 1..39: mol_type = other RNA
cccatctgggtgaagaccccgctgaagctcgccaacggc

SEQ ID NO: 14867 - RNA, 39 nt, synthetic construct
  misc_feature 1..39: note = derived and/or modified sequence opt1 from anti-influenza_CDR
  source 1..39: mol_type = other RNA
caggccagccagtccgtgtacaacaagaacaacctggcc

SEQ ID NO: 14868 - RNA, 39 nt, synthetic construct
  misc_feature 1..39: note = derived and/or modified sequence opt1 from anti-influenza_CDR
  source 1..39: mol_type = other RNA
cagagctccgagagcgtgtacaagaacaacaacctggcc

SEQ ID NO: 14869 - RNA, 39 nt, synthetic construct
  misc_feature 1..39: note = derived and/or modified sequence opt1 from anti-influenza_CDR
  source 1..39: mol_type = other RNA
cagagctcccagagcgtggactccaacaaccagctgagc

SEQ ID NO: 14870 - RNA, 39 nt, synthetic construct
  misc_feature 1..39: note = derived and/or modified sequence opt1 from anti-influenza_CDR
  source 1..39: mol_type = other RNA
cagagctcccagagcgtggacaacaacaaggacctggcc

SEQ ID NO: 14871 - RNA, 39 nt, synthetic construct
  misc_feature 1..39: note = derived and/or modified sequence opt1 from anti-influenza_CDR
  source 1..39: mol_type = other RNA
cagagctcccagagcgtgtacaacaacaaccgcctgtcc

SEQ ID NO: 14872 - RNA, 39 nt, synthetic construct
  misc_feature 1..39: note = derived and/or modified sequence opt1 from anti-influenza_CDR
  source 1..39: mol_type = other RNA
cagagctcccagagcgtgtacaagaacaacaacctggcc

SEQ ID NO: 14873 - RNA, 39 nt, synthetic construct
  misc_feature 1..39: note = derived and/or modified sequence opt1 from anti-influenza_CDR
  source 1..39: mol_type = other RNA
ggcgggggcttcgggtggagccagacctacttcggctac

SEQ ID NO: 14874 - RNA, 42 nt, synthetic construct
  misc_feature 1..42: note = derived and/or modified sequence opt1 from anti-influenza_CDR
  source 1..42: mol_type = other RNA
tggctgggccgcacctactaccggagcaagtggtacaacgac

SEQ ID NO: 14875 - RNA, 42 nt, synthetic construct
  misc_feature 1..42: note = derived and/or modified sequence opt1 from anti-influenza_CDR
  source 1..42: mol_type = other RNA
ggcgggctggtgggcgggtacgacgagtacttcttcgactac

SEQ ID NO: 14876 - RNA, 42 nt, synthetic construct
  misc_feature 1..42: note = derived and/or modified sequence opt1 from anti-influenza_CDR
  source 1..42: mol_type = other RNA
caccccaagtacttctacggcagcgggtcctacccggacttc

SEQ ID NO: 14877 - RNA, 42 nt, synthetic construct
  misc_feature 1..42: note = derived and/or modified sequence opt1 from anti-influenza_CDR
  source 1..42: mol_type = other RNA
accggcagctccagcgacgtgggggcctccaacagcgtctcc

SEQ ID NO: 14878 - RNA, 42 nt, synthetic construct
  misc_feature 1..42: note = derived and/or modified sequence opt1 from anti-influenza_CDR
  source 1..42: mol_type = other RNA
ggcgcctactacgacagctccgggtaccccgccttctacatc

SEQ ID NO: 14879 - RNA, 42 nt, synthetic construct
  misc_feature 1..42: note = derived and/or modified sequence opt1 from anti-influenza_CDR
  source 1..42: mol_type = other RNA
accggcagctccagcaacatcgggtccgactacgacgtgcac

SEQ ID NO: 14880 - RNA, 42 nt, synthetic construct
  misc_feature 1..42: note = derived and/or modified sequence opt1 from anti-influenza_CDR
  source 1..42: mol_type = other RNA
gagttcgagaccagcggctacttccacgggtccttcgactac

SEQ ID NO: 14881 - RNA, 42 nt, synthetic construct
  misc_feature 1..42: note = derived and/or modified sequence opt1 from anti-influenza_CDR
  source 1..42: mol_type = other RNA
gccagctccaccggcgccgtgaccagctcctacttccccaac

SEQ ID NO: 14882 - RNA, 42 nt, synthetic construct
  misc_feature 1..42: note = derived and/or modified sequence opt1 from anti-influenza_CDR
  source 1..42: mol_type = other RNA
accggcgggagctccgacatcggcgccagcaactccgtgagc

SEQ ID NO: 14883 - RNA, 42 nt, synthetic construct
  misc_feature 1..42: note = derived and/or modified sequence opt1 from anti-influenza_CDR
  source 1..42: mol_type = other RNA
accggcagctccagcgacgtcgggggctacgactacgtgtcc

SEQ ID NO: 14884 - RNA, 42 nt, synthetic construct
  misc_feature 1..42: note = derived and/or modified sequence opt1 from anti-influenza_CDR
  source 1..42: mol_type = other RNA
ggcagctccaccggggccgtgacccgcggccactacccctac

SEQ ID NO: 14885 - RNA, 42 nt, synthetic construct
  misc_feature 1..42: note = derived and/or modified sequence opt1 from anti-influenza_CDR
  source 1..42: mol_type = other RNA
ggcagctccaccgggcccgtgaccagcggccactacccgtac

SEQ ID NO: 14886 - RNA, 42 nt, synthetic construct
  misc_feature 1..42: note = derived and/or modified sequence opt1 from anti-influenza_CDR
  source 1..42: mol_type = other RNA
cactacggcgacagcgaggccatcaacgacgccttcgacatc

SEQ ID NO: 14887 - RNA, 42 nt, synthetic construct
  misc_feature 1..42: note = derived and/or modified sequence opt1 from anti-influenza_CDR
  source 1..42: mol_type = other RNA
accggcagctccagcaacatcggggccggctacgacgtgcac

SEQ ID NO: 14888 - RNA, 42 nt, synthetic construct
  misc_feature 1..42: note = derived and/or modified sequence opt1 from anti-influenza_CDR
  source 1..42: mol_type = other RNA
atcccccactacaacttcggcagcgggtcctacttcgactac

SEQ ID NO: 14889 - RNA, 42 nt, synthetic construct
  misc_feature 1..42: note = derived and/or modified sequence opt1 from anti-influenza_CDR
  source 1..42: mol_type = other RNA
accggcaccagctccgacgtcgggggctacaactacgtgagc

SEQ ID NO: 14890 - RNA, 42 nt, synthetic construct
  misc_feature 1..42: note = derived and/or modified sequence opt1 from anti-influenza_CDR
  source 1..42: mol_type = other RNA
accggcaccagctccgacgtgggggcctacaactacgtcagc

SEQ ID NO: 14891 - RNA, 42 nt, synthetic construct
  misc_feature 1..42: note = derived and/or modified sequence opt1 from anti-influenza_CDR
  source 1..42: mol_type = other RNA
gccgagcgccccaaggtgcggggccaggccgggcgcatgaac

SEQ ID NO: 14892 - RNA, 42 nt, synthetic construct
  misc_feature 1..42: note = derived and/or modified sequence opt1 from anti-influenza_CDR
  source 1..42: mol_type = other RNA
ggcagccgcccctgggtgcgcggggtctccagccggatctcc

SEQ ID NO: 14893 - RNA, 42 nt, synthetic construct
  misc_feature 1..42: note = derived and/or modified sequence opt1 from anti-influenza_CDR
  source 1..42: mol_type = other RNA
atctggggcgtggccgcccccgggaccgcggccgcccagatc

SEQ ID NO: 14894 - RNA, 42 nt, synthetic construct
  misc_feature 1..42: note = derived and/or modified sequence opt1 from anti-influenza_CDR
  source 1..42: mol_type = other RNA
tgggtgcgccagcccccgggcaaggggctggagtgggtcgcc

SEQ ID NO: 14895 - RNA, 42 nt, synthetic construct
  misc_feature 1..42: note = derived and/or modified sequence opt1 from anti-influenza_CDR
  source 1..42: mol_type = other RNA
gcccgcggccccgagggggtgtggggccggagcatcgactcc

SEQ ID NO: 14896 - RNA, 42 nt, synthetic construct
  misc_feature 1..42: note = derived and/or modified sequence opt1 from anti-influenza_CDR
  source 1..42: mol_type = other RNA
gcccgcgaccccgacaccccgttcgtgcgggccttcgacagc

SEQ ID NO: 14897 - RNA, 42 nt, synthetic construct
  misc_feature 1..42: note = derived and/or modified sequence opt1 from anti-influenza_CDR
  source 1..42: mol_type = other RNA
accggcagcacctccgacatcgggagctacaactacgtgtcc

SEQ ID NO: 14898 - RNA, 42 nt, synthetic construct
  misc_feature 1..42: note = derived and/or modified sequence opt1 from anti-influenza_CDR
  source 1..42: mol_type = other RNA
tgggactggaacttcgacctgtacctcggctggttcgacccc

SEQ ID NO: 14899 - RNA, 42 nt, synthetic construct
  misc_feature 1..42: note = derived and/or modified sequence opt1 from anti-influenza_CDR
  source 1..42: mol_type = other RNA
tgggcctggaacttcgacttcttcctgggctggttcgacccc

SEQ ID NO: 14900 - RNA, 42 nt, synthetic construct
  misc_feature 1..42: note = derived and/or modified sequence opt1 from anti-influenza_CDR
  source 1..42: mol_type = other RNA
ggccccgggtacagcggctaccactacgggtggttcgacacc

SEQ ID NO: 14901 - RNA, 42 nt, synthetic construct
  misc_feature 1..42: note = derived and/or modified sequence opt1 from anti-influenza_CDR
  source 1..42: mol_type = other RNA
gcccgctgggactacggcgtgtacgaggggtacatcgactac

SEQ ID NO: 14902 - RNA, 45 nt, synthetic construct
  misc_feature 1..45: note = derived and/or modified sequence opt1 from anti-influenza_CDR
  source 1..45: mol_type = other RNA
gcccgcgccggcaccaccctgacgcggttcaactggttcgacccc

SEQ ID NO: 14903 - RNA, 45 nt, synthetic construct
  misc_feature 1..45: note = derived and/or modified sequence opt1 from anti-influenza_CDR
  source 1..45: mol_type = other RNA
gcccgcgccggcaccaccgtgacgcggttcaactggttcgacccc

SEQ ID NO: 14904 - RNA, 45 nt, synthetic construct
  misc_feature 1..45: note = derived and/or modified sequence opt1 from anti-influenza_CDR
  source 1..45: mol_type = other RNA
gcccgcggccagcggtactactacgaccgcgacgggatggacgtg

SEQ ID NO: 14905 - RNA, 45 nt, synthetic construct
  misc_feature 1..45: note = derived and/or modified sequence opt1 from anti-influenza_CDR
  source 1..45: mol_type = other RNA
gcccgcagcggcgggtacctgccccagaacaactggatcgacccg

SEQ ID NO: 14906 - RNA, 45 nt, synthetic construct
  misc_feature 1..45: note = derived and/or modified sequence opt1 from anti-influenza_CDR
  source 1..45: mol_type = other RNA
atggagaacgagcgcaccctggacttccacgacagcaacgtgaag

SEQ ID NO: 14907 - RNA, 45 nt, synthetic construct
  misc_feature 1..45: note = derived and/or modified sequence opt1 from anti-influenza_CDR
  source 1..45: mol_type = other RNA
ggcgccgaccacgggagcggctccaacttcgtgagcccctacgtc

SEQ ID NO: 14908 - RNA, 45 nt, synthetic construct
  misc_feature 1..45: note = derived and/or modified sequence opt1 from anti-influenza_CDR
  source 1..45: mol_type = other RNA
gacacccgcagctccctggacaactaccagtacggcatggacgtg

SEQ ID NO: 14909 - RNA, 45 nt, synthetic construct
  misc_feature 1..45: note = derived and/or modified sequence opt1 from anti-influenza_CDR
  source 1..45: mol_type = other RNA
gaggactacgacatcctgaccggcgccgggcccggcatggaggtg

SEQ ID NO: 14910 - RNA, 45 nt, synthetic construct
  misc_feature 1..45: note = derived and/or modified sequence opt1 from anti-influenza_CDR
  source 1..45: mol_type = other RNA
cacccctacgacgtgctgaccggcagcggggactggttcgacccg

SEQ ID NO: 14911 - RNA, 45 nt, synthetic construct
  misc_feature 1..45: note = derived and/or modified sequence opt1 from anti-influenza_CDR
  source 1..45: mol_type = other RNA
ggcgccgaccacgggagcggcaacaacttcgtgtccccctacgtc

SEQ ID NO: 14912 - RNA, 45 nt, synthetic construct
  misc_feature 1..45: note = derived and/or modified sequence opt1 from anti-influenza_CDR
  source 1..45: mol_type = other RNA
gtgatctacagcggcgggtccacctactacgccgacagcgtcaag

SEQ ID NO: 14913 - RNA, 45 nt, synthetic construct
  misc_feature 1..45: note = derived and/or modified sequence opt1 from anti-influenza_CDR
  source 1..45: mol_type = other RNA
tggtaccagcagaagcccggcaaggccccgaagctgctcatctac

SEQ ID NO: 14914 - RNA, 45 nt, synthetic construct
  misc_feature 1..45: note = derived and/or modified sequence opt1 from anti-influenza_CDR
  source 1..45: mol_type = other RNA
gacccctacaacgacggcaccaagtacaacgagaagttcgagggg

SEQ ID NO: 14915 - RNA, 45 nt, synthetic construct
  misc_feature 1..45: note = derived and/or modified sequence opt1 from anti-influenza_CDR
  source 1..45: mol_type = other RNA
gcccgcgcccacaccgcgctgacccggttccgctggctcgacccc

SEQ ID NO: 14916 - RNA, 45 nt, synthetic construct
  misc_feature 1..45: note = derived and/or modified sequence opt1 from anti-influenza_CDR
  source 1..45: mol_type = other RNA
gccagcctggactacgacttctcctactactaccaccgcgacgtg

SEQ ID NO: 14917 - RNA, 45 nt, synthetic construct
  misc_feature 1..45: note = derived and/or modified sequence opt1 from anti-influenza_CDR
  source 1..45: mol_type = other RNA
gcccgcgtggccaccccctactactacgagagcggcttcgactac

SEQ ID NO: 14918 - RNA, 45 nt, synthetic construct
  misc_feature 1..45: note = derived and/or modified sequence opt1 from anti-influenza_CDR
  source 1..45: mol_type = other RNA
gcccgccggggcgggggctggcagtactactacgggatggacgtg

SEQ ID NO: 14919 - RNA, 48 nt, synthetic construct
  misc_feature 1..48: note = derived and/or modified sequence opt1 from anti-influenza_CDR
  source 1..48: mol_type = other RNA
agcggccacatcaccgtgttcggggtcaacgtggacgccttcgacatg

SEQ ID NO: 14920 - RNA, 48 nt, synthetic construct
  misc_feature 1..48: note = derived and/or modified sequence opt1 from anti-influenza_CDR
  source 1..48: mol_type = other RNA
ggcgggcacatcaccgtgttcggcctgaacatcgacgcctacgacatc

SEQ ID NO: 14921 - RNA, 48 nt, synthetic construct
  misc_feature 1..48: note = derived and/or modified sequence opt1 from anti-influenza_CDR
  source 1..48: mol_type = other RNA
ggcgggcacatcaccgagttcggcctgaacatcgacgcctacgacatc

SEQ ID NO: 14922 - RNA, 48 nt, synthetic construct
  misc_feature 1..48: note = derived and/or modified sequence opt1 from anti-influenza_CDR
  source 1..48: mol_type = other RNA
ggcgggcacatcaccgtgttcggcgtcaacatcgacgccttcgacatc

SEQ ID NO: 14923 - RNA, 48 nt, synthetic construct
  misc_feature 1..48: note = derived and/or modified sequence opt1 from anti-influenza_CDR
  source 1..48: mol_type = other RNA
ggcgggcacatcaccgtgttcggcgtcaacatcgacgccttcgacgtg

SEQ ID NO: 14924 - RNA, 48 nt, synthetic construct
  misc_feature 1..48: note = derived and/or modified sequence opt1 from anti-influenza_CDR
  source 1..48: mol_type = other RNA
gcccgcgacggctgggggcagcagctggtgccctactacttcgactac

SEQ ID NO: 14925 - RNA, 48 nt, synthetic construct
  misc_feature 1..48: note = derived and/or modified sequence opt1 from anti-influenza_CDR
  source 1..48: mol_type = other RNA
gacttctgggtgagctactactacgactccagcgccccgcccgccatc

SEQ ID NO: 14926 - RNA, 48 nt, synthetic construct
  misc_feature 1..48: note = derived and/or modified sequence opt1 from anti-influenza_CDR
  source 1..48: mol_type = other RNA
gcccgcgccggcgtgaagatcttcgggctgatcgtcggcgcgctcgac

SEQ ID NO: 14927 - RNA, 48 nt, synthetic construct
  misc_feature 1..48: note = derived and/or modified sequence opt1 from anti-influenza_CDR
  source 1..48: mol_type = other RNA
gcccgcgacggcgccgggagctactaccccctgaactggttcgacccg

SEQ ID NO: 14928 - RNA, 48 nt, synthetic construct
  misc_feature 1..48: note = derived and/or modified sequence opt1 from anti-influenza_CDR
  source 1..48: mol_type = other RNA
gtgatctacagccacggccgcgcctactactccgccagcgtcaacggg

SEQ ID NO: 14929 - RNA, 48 nt, synthetic construct
  misc_feature 1..48: note = derived and/or modified sequence opt1 from anti-influenza_CDR
  source 1..48: mol_type = other RNA
gacaccctgcacaacggctacaccaactacaaccccagcctccgcggg

SEQ ID NO: 14930 - RNA, 48 nt, synthetic construct
  misc_feature 1..48: note = derived and/or modified sequence opt1 from anti-influenza_CDR
  source 1..48: mol_type = other RNA
tacatcagctacaacggccgccccaagtacaacccgtccctgaccagc

SEQ ID NO: 14931 - RNA, 48 nt, synthetic construct
  misc_feature 1..48: note = derived and/or modified sequence opt1 from anti-influenza_CDR
  source 1..48: mol_type = other RNA
gagacccgcttcggcgagctgctcagcccctacgacgccttcgagatc

SEQ ID NO: 14932 - RNA, 48 nt, synthetic construct
  misc_feature 1..48: note = derived and/or modified sequence opt1 from anti-influenza_CDR
  source 1..48: mol_type = other RNA
ctgatctactgggacgacgacaagcgctacagcccctccctcaagcgg

SEQ ID NO: 14933 - RNA, 48 nt, synthetic construct
  misc_feature 1..48: note = derived and/or modified sequence opt1 from anti-influenza_CDR
  source 1..48: mol_type = other RNA
tacatctactacatcggcaacaccgactaccgccccagcctgaagtcc

SEQ ID NO: 14934 - RNA, 48 nt, synthetic construct
  misc_feature 1..48: note = derived and/or modified sequence opt1 from anti-influenza_CDR
  source 1..48: mol_type = other RNA
gagatcagccacggcgggtccaccaactacaaccccagcctgaagtcc

SEQ ID NO: 14935 - RNA, 48 nt, synthetic construct
  misc_feature 1..48: note = derived and/or modified sequence opt1 from anti-influenza_CDR
  source 1..48: mol_type = other RNA
gagatcaaccacagcggccgcaccaactacaaccccagcctgaagtcc

SEQ ID NO: 14936 - RNA, 48 nt, synthetic construct
  misc_feature 1..48: note = derived and/or modified sequence opt1 from anti-influenza_CDR
  source 1..48: mol_type = other RNA
ctgatcagctgggacgacgagaagcactactcccccagcctccagtcc

SEQ ID NO: 14937 - RNA, 48 nt, synthetic construct
  misc_feature 1..48: note = derived and/or modified sequence opt1 from anti-influenza_CDR
  source 1..48: mol_type = other RNA
gagggcgtgtacttcgacagcgggacctaccgcggctacttcgactac

SEQ ID NO: 14938 - RNA, 48 nt, synthetic construct
  misc_feature 1..48: note = derived and/or modified sequence opt1 from anti-influenza_CDR
  source 1..48: mol_type = other RNA
tacatctaccacagcggctccaccaactacaaccccagcctgaagtcc

SEQ ID NO: 14939 - RNA, 48 nt, synthetic construct
  misc_feature 1..48: note = derived and/or modified sequence opt1 from anti-influenza_CDR
  source 1..48: mol_type = other RNA
tacatctactaccgcggcagcaccttctacaaccccagcctgaagtcc

SEQ ID NO: 14940 - RNA, 48 nt, synthetic construct
  misc_feature 1..48: note = derived and/or modified sequence opt1 from anti-influenza_CDR
  source 1..48: mol_type = other RNA
tacatcagctactccggcagcaccaagtacaacccctccctgcgcagc

SEQ ID NO: 14941 - RNA, 48 nt, synthetic construct
  misc_feature 1..48: note = derived and/or modified sequence opt1 from anti-influenza_CDR
  source 1..48: mol_type = other RNA
gagatcaagcacagcggccgcaccaactacaacccctccctggagagc

SEQ ID NO: 14942 - RNA, 48 nt, synthetic construct
  misc_feature 1..48: note = derived and/or modified sequence opt1 from anti-influenza_CDR
  source 1..48: mol_type = other RNA
gagatcaaccacagcggcgggaccaactacaacccctccctgaagcgc

SEQ ID NO: 14943 - RNA, 48 nt, synthetic construct
  misc_feature 1..48: note = derived and/or modified sequence opt1 from anti-influenza_CDR
  source 1..48: mol_type = other RNA
ttcatgtactacagcgcctccacctactacaaccccagcctgaagtcc

SEQ ID NO: 14944 - RNA, 48 nt, synthetic construct
  misc_feature 1..48: note = derived and/or modified sequence opt1 from anti-influenza_CDR
  source 1..48: mol_type = other RNA
tacgtgtactacagcggctccaccacctacaaccccagcctgaagtcc

SEQ ID NO: 14945 - RNA, 48 nt, synthetic construct
  misc_feature 1..48: note = derived and/or modified sequence opt1 from anti-influenza_CDR
  source 1..48: mol_type = other RNA
aacatctactacaccggcatcaccttctacaaccccagcctgtccagc

SEQ ID NO: 14946 - RNA, 48 nt, synthetic construct
  misc_feature 1..48: note = derived and/or modified sequence opt1 from anti-influenza_CDR
  source 1..48: mol_type = other RNA
ttcatctactacggcgggaacaccaagtacaaccccagcctgaagtcc

SEQ ID NO: 14947 - RNA, 48 nt, synthetic construct
  misc_feature 1..48: note = derived and/or modified sequence opt1 from anti-influenza_CDR
  source 1..48: mol_type = other RNA
ttcatgttccacagcggcagcccccgctacaacccgaccctgaagtcc

SEQ ID NO: 14948 - RNA, 48 nt, synthetic construct
  misc_feature 1..48: note = derived and/or modified sequence opt1 from anti-influenza_CDR
  source 1..48: mol_type = other RNA
ttcttctacaacggcgggagcaccaagtacaaccccagcctgaagtcc

SEQ ID NO: 14949 - RNA, 48 nt, synthetic construct
  misc_feature 1..48: note = derived and/or modified sequence opt1 from anti-influenza_CDR
  source 1..48: mol_type = other RNA
cacatctacgactacggccgcaccttctacaacagctccctgcagagc

SEQ ID NO: 14950 - RNA, 48 nt, synthetic construct
  misc_feature 1..48: note = derived and/or modified sequence opt1 from anti-influenza_CDR
  source 1..48: mol_type = other RNA
gtgttctacagcgagacccgcacctactacgccgactccgtcaagggc

SEQ ID NO: 14951 - RNA, 48 nt, synthetic construct
  misc_feature 1..48: note = derived and/or modified sequence opt1 from anti-influenza_CDR
  source 1..48: mol_type = other RNA
tacgtgtacaaccgcggcagcaccaagtactcccccagcctgaagtcc

SEQ ID NO: 14952 - RNA, 48 nt, synthetic construct
  misc_feature 1..48: note = derived and/or modified sequence opt1 from anti-influenza_CDR
  source 1..48: mol_type = other RNA
tacatctacaaccgcggcagcaccaagtacacccccagcctgaagtcc

SEQ ID NO: 14953 - RNA, 48 nt, synthetic construct
  misc_feature 1..48: note = derived and/or modified sequence opt1 from anti-influenza_CDR
  source 1..48: mol_type = other RNA
tacctgtactacagcggctccaccaagtacaaccccagcctcaagtcc

SEQ ID NO: 14954 - RNA, 48 nt, synthetic construct
  misc_feature 1..48: note = derived and/or modified sequence opt1 from anti-influenza_CDR
  source 1..48: mol_type = other RNA
tacgtgtacaacagcggcaacaccaagtacaaccccagcctgaagtcc

SEQ ID NO: 14955 - RNA, 48 nt, synthetic construct
  misc_feature 1..48: note = derived and/or modified sequence opt1 from anti-influenza_CDR
  source 1..48: mol_type = other RNA
cacatcttcgacagcggctccacctactacaaccccagcctgaagtcc

SEQ ID NO: 14956 - RNA, 48 nt, synthetic construct
  misc_feature 1..48: note = derived and/or modified sequence opt1 from anti-influenza_CDR
  source 1..48: mol_type = other RNA
gtgttctacagcgccgaccgcacctcctacgccgacagcgtcaagggc

SEQ ID NO: 14957 - RNA, 48 nt, synthetic construct
  misc_feature 1..48: note = derived and/or modified sequence opt1 from anti-influenza_CDR
  source 1..48: mol_type = other RNA
tacatctactacagcggcaacacctactacaaccccagcctgaagtcc

SEQ ID NO: 14958 - RNA, 48 nt, synthetic construct
  misc_feature 1..48: note = derived and/or modified sequence opt1 from anti-influenza_CDR
  source 1..48: mol_type = other RNA
cgcagctcccagagcctgctccactccaacggctacaactacctggac

SEQ ID NO: 14959 - RNA, 48 nt, synthetic construct
  misc_feature 1..48: note = derived and/or modified sequence opt1 from anti-influenza_CDR
  source 1..48: mol_type = other RNA
accatctaccacagcggctccacctactacaaccccagcctgaagtcc

SEQ ID NO: 14960 - RNA, 48 nt, synthetic construct
  misc_feature 1..48: note = derived and/or modified sequence opt1 from anti-influenza_CDR
  source 1..48: mol_type = other RNA
cgcagctcccagagcctgctccactccaacggccacatctacttcgac

SEQ ID NO: 14961 - RNA, 48 nt, synthetic construct
  misc_feature 1..48: note = derived and/or modified sequence opt1 from anti-influenza_CDR
  source 1..48: mol_type = other RNA
atctggggcgtggccgcccccagcaccgcgtccgcccagaccagcctg

SEQ ID NO: 14962 - RNA, 48 nt, synthetic construct
  misc_feature 1..48: note = derived and/or modified sequence opt1 from anti-influenza_CDR
  source 1..48: mol_type = other RNA
cgcagctcccagagcctgctctacaccgacggcttcacctacctgtcc

SEQ ID NO: 14963 - RNA, 48 nt, synthetic construct
  misc_feature 1..48: note = derived and/or modified sequence opt1 from anti-influenza_CDR
  source 1..48: mol_type = other RNA
gccaagccccgcctggactacctcgactacttccacgccgcggacagc

SEQ ID NO: 14964 - RNA, 48 nt, synthetic construct
  misc_feature 1..48: note = derived and/or modified sequence opt1 from anti-influenza_CDR
  source 1..48: mol_type = other RNA
gcccgcagccccggctactccgggtacctgtacggctggttcgacccg

SEQ ID NO: 14965 - RNA, 48 nt, synthetic construct
  misc_feature 1..48: note = derived and/or modified sequence opt1 from anti-influenza_CDR
  source 1..48: mol_type = other RNA
gccatcgccggcagcgggtccgcggactacgccagctgggccaagggc

SEQ ID NO: 14966 - RNA, 48 nt, synthetic construct
  misc_feature 1..48: note = derived and/or modified sequence opt1 from anti-influenza_CDR
  source 1..48: mol_type = other RNA
gccatcgccggcagcgggtccgcggactacgccagctgggccaagtcc

SEQ ID NO: 14967 - RNA, 48 nt, synthetic construct
  misc_feature 1..48: note = derived and/or modified sequence opt1 from anti-influenza_CDR
  source 1..48: mol_type = other RNA
gccatcggcgggggcgggagcgccgactacgcgtcctgggccaagagc

SEQ ID NO: 14968 - RNA, 48 nt, synthetic construct
  misc_feature 1..48: note = derived and/or modified sequence opt1 from anti-influenza_CDR
  source 1..48: mol_type = other RNA
cgcagctcccagagcctgctccggtccaacggctacaactacctggac

SEQ ID NO: 14969 - RNA, 48 nt, synthetic construct
  misc_feature 1..48: note = derived and/or modified sequence opt1 from anti-influenza_CDR
  source 1..48: mol_type = other RNA
cagggcgaccacatcgcctggctgctccgcgggatcaacttcgactac

SEQ ID NO: 14970 - RNA, 51 nt, synthetic construct
  misc_feature 1..51: note = derived and/or modified sequence opt1 from anti-influenza_CDR
  source 1..51: mol_type = other RNA
gcccgcctgggcagcgggtcctaccacaacggccccaactggttcgacccg

SEQ ID NO: 14971 - RNA, 51 nt, synthetic construct
  misc_feature 1..51: note = derived and/or modified sequence opt1 from anti-influenza_CDR
  source 1..51: mol_type = other RNA
gcccgcgccgagaacctgctcagcccctacctggcggagggcttcgacccg

SEQ ID NO: 14972 - RNA, 51 nt, synthetic construct
  misc_feature 1..51: note = derived and/or modified sequence opt1 from anti-influenza_CDR
  source 1..51: mol_type = other RNA
gtgatcagctacgacggctccaacaagtactacgccgacagcgtcaagggg

SEQ ID NO: 14973 - RNA, 51 nt, synthetic construct
  misc_feature 1..51: note = derived and/or modified sequence opt1 from anti-influenza_CDR
  source 1..51: mol_type = other RNA
ggcaccatccccctgctcgggaccacgaactacgcccagaagttccagggc

SEQ ID NO: 14974 - RNA, 51 nt, synthetic construct
  misc_feature 1..51: note = derived and/or modified sequence opt1 from anti-influenza_CDR
  source 1..51: mol_type = other RNA
ggcatcatcgccgtgttcaacaccgccaactacgcgcagaagttccagggg

SEQ ID NO: 14975 - RNA, 51 nt, synthetic construct
  misc_feature 1..51: note = derived and/or modified sequence opt1 from anti-influenza_CDR
  source 1..51: mol_type = other RNA
aacatcgaggacgacggcggggacaagtactacgtggacagcgtcaagggc

SEQ ID NO: 14976 - RNA, 51 nt, synthetic construct
  misc_feature 1..51: note = derived and/or modified sequence opt1 from anti-influenza_CDR
  source 1..51: mol_type = other RNA
tggatcaaccccaacagcggcaccaccgggtccgcccagcgcttccagggc

SEQ ID NO: 14977 - RNA, 51 nt, synthetic construct
  misc_feature 1..51: note = derived and/or modified sequence opt1 from anti-influenza_CDR
  source 1..51: mol_type = other RNA
ggcatcaaccccgtgttcgggcgcccgcactacgcccagaagttccagggc

SEQ ID NO: 14978 - RNA, 51 nt, synthetic construct
  misc_feature 1..51: note = derived and/or modified sequence opt1 from anti-influenza_CDR
  source 1..51: mol_type = other RNA
ggcatcatccccctgatcaacgccccgaactacgcccccaagttccagggg

SEQ ID NO: 14979 - RNA, 51 nt, synthetic construct
  misc_feature 1..51: note = derived and/or modified sequence opt1 from anti-influenza_CDR
  source 1..51: mol_type = other RNA
ggcatcatccccatgatggggaccgtgaactacgcccagaagctgcagggc

SEQ ID NO: 14980 - RNA, 51 nt, synthetic construct
  misc_feature 1..51: note = derived and/or modified sequence opt1 from anti-influenza_CDR
  source 1..51: mol_type = other RNA
ggcatcatccccctgttcggggccgccaagtacgcgcagaagttccagggc

SEQ ID NO: 14981 - RNA, 51 nt, synthetic construct
  misc_feature 1..51: note = derived and/or modified sequence opt1 from anti-influenza_CDR
  source 1..51: mol_type = other RNA
aagagctcccagcgcgtgctgtacagctccaacaacaagaactacctcgcc

SEQ ID NO: 14982 - RNA, 51 nt, synthetic construct
  misc_feature 1..51: note = derived and/or modified sequence opt1 from anti-influenza_CDR
  source 1..51: mol_type = other RNA
ctgatcagcgacgacggctccaacaagttctacgccgacagcgtgaagggg

SEQ ID NO: 14983 - RNA, 51 nt, synthetic construct
  misc_feature 1..51: note = derived and/or modified sequence opt1 from anti-influenza_CDR
  source 1..51: mol_type = other RNA
atcatcagctacgacggcaacgaccagtactacaccgactccgtgaagggg

SEQ ID NO: 14984 - RNA, 51 nt, synthetic construct
  misc_feature 1..51: note = derived and/or modified sequence opt1 from anti-influenza_CDR
  source 1..51: mol_type = other RNA
tggatcagcacctacaacggcaacaccaacttcgcccagaacttccagggg

SEQ ID NO: 14985 - RNA, 51 nt, synthetic construct
  misc_feature 1..51: note = derived and/or modified sequence opt1 from anti-influenza_CDR
  source 1..51: mol_type = other RNA
gtggagggcagctaccgcgacttctggaacaaccagaaccggttcgacccc

SEQ ID NO: 14986 - RNA, 51 nt, synthetic construct
  misc_feature 1..51: note = derived and/or modified sequence opt1 from anti-influenza_CDR
  source 1..51: mol_type = other RNA
tggatcaaccccaacagcggcgacaccaactacgcccagaagttccagggg

SEQ ID NO: 14987 - RNA, 51 nt, synthetic construct
  misc_feature 1..51: note = derived and/or modified sequence opt1 from anti-influenza_CDR
  source 1..51: mol_type = other RNA
aagagctcccagagcgtgctgtactccagcaacaacaagtcccacctcgcc

SEQ ID NO: 14988 - RNA, 51 nt, synthetic construct
  misc_feature 1..51: note = derived and/or modified sequence opt1 from anti-influenza_CDR
  source 1..51: mol_type = other RNA
atcatctaccccggcgacagcgacacccgctactccccgagcttccagggg

SEQ ID NO: 14989 - RNA, 51 nt, synthetic construct
  misc_feature 1..51: note = derived and/or modified sequence opt1 from anti-influenza_CDR
  source 1..51: mol_type = other RNA
ggcatcatccccgtgttcccgacccccaactacgcccagatgttccagggg

SEQ ID NO: 14990 - RNA, 51 nt, synthetic construct
  misc_feature 1..51: note = derived and/or modified sequence opt1 from anti-influenza_CDR
  source 1..51: mol_type = other RNA
ggcatcgtgcccgtcttcgggaccgccaactacgcccagaagttccagggc

SEQ ID NO: 14991 - RNA, 51 nt, synthetic construct
  misc_feature 1..51: note = derived and/or modified sequence opt1 from anti-influenza_CDR
  source 1..51: mol_type = other RNA
tggatcaaccccgagagcggcgacaccaagtacgcccagaagttccagggg

SEQ ID NO: 14992 - RNA, 51 nt, synthetic construct
  misc_feature 1..51: note = derived and/or modified sequence opt1 from anti-influenza_CDR
  source 1..51: mol_type = other RNA
cgcagctcccagagcatcttccacaactccaacaacgagaactacctggcc

SEQ ID NO: 14993 - RNA, 51 nt, synthetic construct
  misc_feature 1..51: note = derived and/or modified sequence opt1 from anti-influenza_CDR
  source 1..51: mol_type = other RNA
tggatcaacgccaagcgcggcgggaccaactacgcccagaagttccagggc

SEQ ID NO: 14994 - RNA, 51 nt, synthetic construct
  misc_feature 1..51: note = derived and/or modified sequence opt1 from anti-influenza_CDR
  source 1..51: mol_type = other RNA
tggatcaaccccgacagcggcgccacctccagcgcccagaacttccagggg

SEQ ID NO: 14995 - RNA, 51 nt, synthetic construct
  misc_feature 1..51: note = derived and/or modified sequence opt1 from anti-influenza_CDR
  source 1..51: mol_type = other RNA
tggatcagccccgactccgacgccaccaagtacgcccagaagttccagggc

SEQ ID NO: 14996 - RNA, 51 nt, synthetic construct
  misc_feature 1..51: note = derived and/or modified sequence opt1 from anti-influenza_CDR
  source 1..51: mol_type = other RNA
aacatcaagcaggacggccgcgagaagtactacgtggacagcctgcggggg

SEQ ID NO: 14997 - RNA, 51 nt, synthetic construct
  misc_feature 1..51: note = derived and/or modified sequence opt1 from anti-influenza_CDR
  source 1..51: mol_type = other RNA
ggcatcatcgccatcttcgggacccccaagtacgcccagaagttccagggc

SEQ ID NO: 14998 - RNA, 51 nt, synthetic construct
  misc_feature 1..51: note = derived and/or modified sequence opt1 from anti-influenza_CDR
  source 1..51: mol_type = other RNA
aagagctcccagagcatcctgaactccagcaacaacaagaactacctcgcc

SEQ ID NO: 14999 - RNA, 51 nt, synthetic construct
  misc_feature 1..51: note = derived and/or modified sequence opt1 from anti-influenza_CDR
  source 1..51: mol_type = other RNA
tggatcagcgcctacaacggcaacaccaactacgcccagaagttccagggg

SEQ ID NO: 15000 - RNA, 51 nt, synthetic construct
  misc_feature 1..51: note = derived and/or modified sequence opt1 from anti-influenza_CDR
  source 1..51: mol_type = other RNA
ggcgtgatccccatcttccgcaccgccaactacgcccagaacttccagggg

SEQ ID NO: 15001 - RNA, 51 nt, synthetic construct
  misc_feature 1..51: note = derived and/or modified sequence opt1 from anti-influenza_CDR
  source 1..51: mol_type = other RNA
ggcatcatcgccatcttccacacccccaagtacgcccagaagttccagggg

SEQ ID NO: 15002 - RNA, 51 nt, synthetic construct
  misc_feature 1..51: note = derived and/or modified sequence opt1 from anti-influenza_CDR
  source 1..51: mol_type = other RNA
ggcatcagccccatgttcgggaccaccacgtacgcccagaagttccagggc

SEQ ID NO: 15003 - RNA, 51 nt, synthetic construct
  misc_feature 1..51: note = derived and/or modified sequence opt1 from anti-influenza_CDR
  source 1..51: mol_type = other RNA
aagagctcccagagcgtgctgtactccagcaacaacaagaactacctcgcc

SEQ ID NO: 15004 - RNA, 51 nt, synthetic construct
  misc_feature 1..51: note = derived and/or modified sequence opt1 from anti-influenza_CDR
  source 1..51: mol_type = other RNA
ggcatcatccccatcttcgggaccaccaagtacgccccgaagttccagggc

SEQ ID NO: 15005 - RNA, 51 nt, synthetic construct
  misc_feature 1..51: note = derived and/or modified sequence opt1 from anti-influenza_CDR
  source 1..51: mol_type = other RNA
ggcatcagccccctgttcgggaccaccaactacgcccagaagttccagggc

SEQ ID NO: 15006 - RNA, 51 nt, synthetic construct
  misc_feature 1..51: note = derived and/or modified sequence opt1 from anti-influenza_CDR
  source 1..51: mol_type = other RNA
ggcatcatggggatgttcggcaccaccaactacgcccagaagttccagggg

SEQ ID NO: 15007 - RNA, 51 nt, synthetic construct
  misc_feature 1..51: note = derived and/or modified sequence opt1 from anti-influenza_CDR
  source 1..51: mol_type = other RNA
ggcatcatcgggatgttcggcagcaccaactacgcccagaacttccagggg

SEQ ID NO: 15008 - RNA, 51 nt, synthetic construct
  misc_feature 1..51: note = derived and/or modified sequence opt1 from anti-influenza_CDR
  source 1..51: mol_type = other RNA
tggatcaaccccaacagcggcgggaccaactacgcccagaagttccagggc

SEQ ID NO: 15009 - RNA, 51 nt, synthetic construct
  misc_feature 1..51: note = derived and/or modified sequence opt1 from anti-influenza_CDR
  source 1..51: mol_type = other RNA
gccatcagctccagcggcgactccacctactacgccgacagcgtgaagggg

SEQ ID NO: 15010 - RNA, 51 nt, synthetic construct
  misc_feature 1..51: note = derived and/or modified sequence opt1 from anti-influenza_CDR
  source 1..51: mol_type = other RNA
agcatctccagctccagctcctacatctactacgtggacagcgtcaagggc

SEQ ID NO: 15011 - RNA, 51 nt, synthetic construct
  misc_feature 1..51: note = derived and/or modified sequence opt1 from anti-influenza_CDR
  source 1..51: mol_type = other RNA
gacatcatcggcatgttcgggagcaccaactacgcccagaacttccagggc

SEQ ID NO: 15012 - RNA, 51 nt, synthetic construct
  misc_feature 1..51: note = derived and/or modified sequence opt1 from anti-influenza_CDR
  source 1..51: mol_type = other RNA
ggcatcatccccatgttcgggaccaccaactacgcccagaagttccagggc

SEQ ID NO: 15013 - RNA, 51 nt, synthetic construct
  misc_feature 1..51: note = derived and/or modified sequence opt1 from anti-influenza_CDR
  source 1..51: mol_type = other RNA
ggcatcatcgccatcttcgggaccgccaactacgcgcagaagttccagggc

SEQ ID NO: 15014 - RNA, 51 nt, synthetic construct
  misc_feature 1..51: note = derived and/or modified sequence opt1 from anti-influenza_CDR
  source 1..51: mol_type = other RNA
ggcatcatccccatcttcgggaccaccaactacgcccagaagttccagggc

SEQ ID NO: 15015 - RNA, 51 nt, synthetic construct
  misc_feature 1..51: note = derived and/or modified sequence opt1 from anti-influenza_CDR
  source 1..51: mol_type = other RNA
ggcatcttcgccctgttcgggaccaccgactacgcccagaagttccagggc

SEQ ID NO: 15016 - RNA, 51 nt, synthetic construct
  misc_feature 1..51: note = derived and/or modified sequence opt1 from anti-influenza_CDR
  source 1..51: mol_type = other RNA
ggcatcatcgggatgttcggcaccgccaactacgcccagaagttccagggg

SEQ ID NO: 15017 - RNA, 51 nt, synthetic construct
  misc_feature 1..51: note = derived and/or modified sequence opt1 from anti-influenza_CDR
  source 1..51: mol_type = other RNA
ggcatcatcgccgtgttcgggaccaccaagtacgcccacaagttccagggc

SEQ ID NO: 15018 - RNA, 51 nt, synthetic construct
  misc_feature 1..51: note = derived and/or modified sequence opt1 from anti-influenza_CDR
  source 1..51: mol_type = other RNA
ggcatcctgggggtgttcggcagcccctcctacgcccagaagttccagggg

SEQ ID NO: 15019 - RNA, 51 nt, synthetic construct
  misc_feature 1..51: note = derived and/or modified sequence opt1 from anti-influenza_CDR
  source 1..51: mol_type = other RNA
ggcatcttcgggatgttcggcaccgccaactacgcccagaagttccagggg

SEQ ID NO: 15020 - RNA, 51 nt, synthetic construct
  misc_feature 1..51: note = derived and/or modified sequence opt1 from anti-influenza_CDR
  source 1..51: mol_type = other RNA
tggatcagcgcctacaccggcgacaccgactacgcccagaagttccagggg

SEQ ID NO: 15021 - RNA, 51 nt, synthetic construct
  misc_feature 1..51: note = derived and/or modified sequence opt1 from anti-influenza_CDR
  source 1..51: mol_type = other RNA
agcttcgaccccgaggacggcgagaccatctacgcccagaagttccagggg

SEQ ID NO: 15022 - RNA, 51 nt, synthetic construct
  misc_feature 1..51: note = derived and/or modified sequence opt1 from anti-influenza_CDR
  source 1..51: mol_type = other RNA
ggcatcagcgggtccggcgagagcacctactacgccgactccgtgaagggg

SEQ ID NO: 15023 - RNA, 51 nt, synthetic construct
  misc_feature 1..51: note = derived and/or modified sequence opt1 from anti-influenza_CDR
  source 1..51: mol_type = other RNA
gtggtcagctacgacggcaactacaagtactacgccgactccgtgcagggg

SEQ ID NO: 15024 - RNA, 51 nt, synthetic construct
  misc_feature 1..51: note = derived and/or modified sequence opt1 from anti-influenza_CDR
  source 1..51: mol_type = other RNA
ggcagcatctcctacagcgggtccacctactaccaccccagcctgaagtcc

SEQ ID NO: 15025 - RNA, 51 nt, synthetic construct
  misc_feature 1..51: note = derived and/or modified sequence opt1 from anti-influenza_CDR
  source 1..51: mol_type = other RNA
acccgcggccggcccatcgggcgcaactgggagccgcgggacaaggactac

SEQ ID NO: 15026 - RNA, 51 nt, synthetic construct
  misc_feature 1..51: note = derived and/or modified sequence opt1 from anti-influenza_CDR
  source 1..51: mol_type = other RNA
gcccgcgaggccggctaccacagctccttcagcggggtgtacttcgactac

SEQ ID NO: 15027 - RNA, 51 nt, synthetic construct
  misc_feature 1..51: note = derived and/or modified sequence opt1 from anti-influenza_CDR
  source 1..51: mol_type = other RNA
cgcatcgaccccaacggcagcgggaccacctacgcccagaagttccagggc

SEQ ID NO: 15028 - RNA, 51 nt, synthetic construct
  misc_feature 1..51: note = derived and/or modified sequence opt1 from anti-influenza_CDR
  source 1..51: mol_type = other RNA
cgcatcgaccccaacggcgccgggaccacctacgcccagaagttccagggc

SEQ ID NO: 15029 - RNA, 51 nt, synthetic construct
  misc_feature 1..51: note = derived and/or modified sequence opt1 from anti-influenza_CDR
  source 1..51: mol_type = other RNA
tggatcgaccccaacaacgacggcaccatctacgcccagaagttccagggg

SEQ ID NO: 15030 - RNA, 51 nt, synthetic construct
  misc_feature 1..51: note = derived and/or modified sequence opt1 from anti-influenza_CDR
  source 1..51: mol_type = other RNA
atgatgtaccccggcgacagcgacaccatctactccccgagcttccagggg

SEQ ID NO: 15031 - RNA, 51 nt, synthetic construct
  misc_feature 1..51: note = derived and/or modified sequence opt1 from anti-influenza_CDR
  source 1..51: mol_type = other RNA
atgatgtaccccggcgacgccgacgccatctacagcccgtccttccagggg

SEQ ID NO: 15032 - RNA, 51 nt, synthetic construct
  misc_feature 1..51: note = derived and/or modified sequence opt1 from anti-influenza_CDR
  source 1..51: mol_type = other RNA
atgatgtaccccggcgagagcgagaccatctactccccgagcttccagggg

SEQ ID NO: 15033 - RNA, 51 nt, synthetic construct
  misc_feature 1..51: note = derived and/or modified sequence opt1 from anti-influenza_CDR
  source 1..51: mol_type = other RNA
atgatgtaccccggcgacgccgacaccatctacagcccgtccttccagggg

SEQ ID NO: 15034 - RNA, 51 nt, synthetic construct
  misc_feature 1..51: note = derived and/or modified sequence opt1 from anti-influenza_CDR
  source 1..51: mol_type = other RNA
atgatgtaccccggcagctccgacaccatctacagcccgtccttccagggg

SEQ ID NO: 15035 - RNA, 51 nt, synthetic construct
  misc_feature 1..51: note = derived and/or modified sequence opt1 from anti-influenza_CDR
  source 1..51: mol_type = other RNA
atgatgtaccccggcgacagcgacgccatctactccccgagcttccagggg

SEQ ID NO: 15036 - RNA, 51 nt, synthetic construct
  misc_feature 1..51: note = derived and/or modified sequence opt1 from anti-influenza_CDR
  source 1..51: mol_type = other RNA
atgatgtaccccggcgacaccgacaccatctacagcccgtccttccagggg

SEQ ID NO: 15037 - RNA, 51 nt, synthetic construct
  misc_feature 1..51: note = derived and/or modified sequence opt1 from anti-influenza_CDR
  source 1..51: mol_type = other RNA
atgatgtaccccggcgagagcgacaccatctactccccgagcttccagggg

SEQ ID NO: 15038 - RNA, 51 nt, synthetic construct
  misc_feature 1..51: note = derived and/or modified sequence opt1 from anti-influenza_CDR
  source 1..51: mol_type = other RNA
gtgatcagctgggactccggccgcatcgggtacgccgacagcgtcaagggc

SEQ ID NO: 15039 - RNA, 51 nt, synthetic construct
  misc_feature 1..51: note = derived and/or modified sequence opt1 from anti-influenza_CDR
  source 1..51: mol_type = other RNA
gtgcgcagcggcgcctactacttcaactacctggtcccctacttcgactac

SEQ ID NO: 15040 - RNA, 51 nt, synthetic construct
  misc_feature 1..51: note = derived and/or modified sequence opt1 from anti-influenza_CDR
  source 1..51: mol_type = other RNA
gtgcgcagcggcgcctactacgtcaactacctggtgccctacttcgactac

SEQ ID NO: 15041 - RNA, 51 nt, synthetic construct
  misc_feature 1..51: note = derived and/or modified sequence opt1 from anti-influenza_CDR
  source 1..51: mol_type = other RNA
atcatcagctgggactccggccgcatcgggtacgccgacagcgtgcggggc

SEQ ID NO: 15042 - RNA, 51 nt, synthetic construct
  misc_feature 1..51: note = derived and/or modified sequence opt1 from anti-influenza_CDR
  source 1..51: mol_type = other RNA
cacggcggggtgtactactacggcagcgcctccagcgggtggttcgacccc

SEQ ID NO: 15043 - RNA, 54 nt, synthetic construct
  misc_feature 1..54: note = derived and/or modified sequence opt1 from anti-influenza_CDR
  source 1..54: mol_type = other RNA
cgcacctactaccggagcaagtggtacaacgactacgccgagagcgtgaagtcc

SEQ ID NO: 15044 - RNA, 54 nt, synthetic construct
  misc_feature 1..54: note = derived and/or modified sequence opt1 from anti-influenza_CDR
  source 1..54: mol_type = other RNA
cgcacctactaccggagcaagtggtactacgactacgccgagagcgtgaagtcc

SEQ ID NO: 15045 - RNA, 54 nt, synthetic construct
  misc_feature 1..54: note = derived and/or modified sequence opt1 from anti-influenza_CDR
  source 1..54: mol_type = other RNA
cgcacctactaccggagcaagtggtacaacgactacgccgtgtccgtcaagagc

SEQ ID NO: 15046 - RNA, 54 nt, synthetic construct
  misc_feature 1..54: note = derived and/or modified sequence opt1 from anti-influenza_CDR
  source 1..54: mol_type = other RNA
cgcacctactaccggagcaagtggtacaacgactacgccgacttcctgaagcgc

SEQ ID NO: 15047 - RNA, 54 nt, synthetic construct
  misc_feature 1..54: note = derived and/or modified sequence opt1 from anti-influenza_CDR
  source 1..54: mol_type = other RNA
cgcacctactaccggagcggctggtacaacgactacgccgagagcgtgaagtcc

SEQ ID NO: 15048 - RNA, 54 nt, synthetic construct
  misc_feature 1..54: note = derived and/or modified sequence opt1 from anti-influenza_CDR
  source 1..54: mol_type = other RNA
gcccgcctgggcgggaacaaggactacggcgactacctctggtacttcgacctg

SEQ ID NO: 15049 - RNA, 54 nt, synthetic construct
  misc_feature 1..54: note = derived and/or modified sequence opt1 from anti-influenza_CDR
  source 1..54: mol_type = other RNA
gccaaggacaccgccgaccacggcgactacgtggacctggggttcttcgacgcg

SEQ ID NO: 15050 - RNA, 54 nt, synthetic construct
  misc_feature 1..54: note = derived and/or modified sequence opt1 from anti-influenza_CDR
  source 1..54: mol_type = other RNA
gcccgcagcggcatcttcgactggtccgcgcccctggtggaggccttcgacatc

SEQ ID NO: 15051 - RNA, 54 nt, synthetic construct
  misc_feature 1..54: note = derived and/or modified sequence opt1 from anti-influenza_CDR
  source 1..54: mol_type = other RNA
gcccgccacgccagctgctccgcgcggagctgctactggggccccgtggactac

SEQ ID NO: 15052 - RNA, 54 nt, synthetic construct
  misc_feature 1..54: note = derived and/or modified sequence opt1 from anti-influenza_CDR
  source 1..54: mol_type = other RNA
gacgccccgcccaacgtggaggtcgccagcatgaccaactggtacttcgacctg

SEQ ID NO: 15053 - RNA, 54 nt, synthetic construct
  misc_feature 1..54: note = derived and/or modified sequence opt1 from anti-influenza_CDR
  source 1..54: mol_type = other RNA
ctgcgcaccgactacggcgaccccgacagcgtgtactactacgggatggacgtc

SEQ ID NO: 15054 - RNA, 54 nt, synthetic construct
  misc_feature 1..54: note = derived and/or modified sequence opt1 from anti-influenza_CDR
  source 1..54: mol_type = other RNA
gggacctgcgccggcgactgcagcctgcactactactactacggcctcgacgtg

SEQ ID NO: 15055 - RNA, 54 nt, synthetic construct
  misc_feature 1..54: note = derived and/or modified sequence opt1 from anti-influenza_CDR
  source 1..54: mol_type = other RNA
cacgtgagcgtctcccacggcgggcgcaccaagagcaacccctccgtgatgagc

SEQ ID NO: 15056 - RNA, 54 nt, synthetic construct
  misc_feature 1..54: note = derived and/or modified sequence opt1 from anti-influenza_CDR
  source 1..54: mol_type = other RNA
gccctgatctacttcgacggcagcaagcagtactacgccgactccgtgaagggg

SEQ ID NO: 15057 - RNA, 54 nt, synthetic construct
  misc_feature 1..54: note = derived and/or modified sequence opt1 from anti-influenza_CDR
  source 1..54: mol_type = other RNA
accctgatcagctacgacggcgccaaccagtactacgccgactccgtgaagggg

SEQ ID NO: 15058 - RNA, 54 nt, synthetic construct
  misc_feature 1..54: note = derived and/or modified sequence opt1 from anti-influenza_CDR
  source 1..54: mol_type = other RNA
gccgtgcccggccccgtcttcgggatcttcccgccctggagctacttcgacaac

SEQ ID NO: 15059 - RNA, 54 nt, synthetic construct
  misc_feature 1..54: note = derived and/or modified sequence opt1 from anti-influenza_CDR
  source 1..54: mol_type = other RNA
ggcgggatcatccccatcttcggcgccgccaactacgcgcagaagttccagggg

SEQ ID NO: 15060 - RNA, 54 nt, synthetic construct
  misc_feature 1..54: note = derived and/or modified sequence opt1 from anti-influenza_CDR
  source 1..54: mol_type = other RNA
ggctggatcagcgcctacaccgggaacacccactacgccaagaacttcgagggc

SEQ ID NO: 15061 - RNA, 54 nt, synthetic construct
  misc_feature 1..54: note = derived and/or modified sequence opt1 from anti-influenza_CDR
  source 1..54: mol_type = other RNA
ggctggatcaaccccaacttcgggggcacccactacgcccgcaagttccagggg

SEQ ID NO: 15062 - RNA, 54 nt, synthetic construct
  misc_feature 1..54: note = derived and/or modified sequence opt1 from anti-influenza_CDR
  source 1..54: mol_type = other RNA
gtgcgctggcgggccgccgcggtcatcatggaccagttctacaagatggacgtg

SEQ ID NO: 15063 - RNA, 54 nt, synthetic construct
  misc_feature 1..54: note = derived and/or modified sequence opt1 from anti-influenza_CDR
  source 1..54: mol_type = other RNA
gccgtgcccggccccatcttcgggatcttcccgccctggagctacttcgaccac

SEQ ID NO: 15064 - RNA, 54 nt, synthetic construct
  misc_feature 1..54: note = derived and/or modified sequence opt1 from anti-influenza_CDR
  source 1..54: mol_type = other RNA
gccgccagcaccgcgacctccggcacgtactacgccatgcgccccttcgacttc

SEQ ID NO: 15065 - RNA, 57 nt, synthetic construct
  misc_feature 1..57: note = derived and/or modified sequence opt1 from anti-influenza_CDR
  source 1..57: mol_type = other RNA
gcccgcggcaagcggcccgggtactgcagcggcggggtgtgctccagcgactactgg

SEQ ID NO: 15066 - RNA, 57 nt, synthetic construct
  misc_feature 1..57: note = derived and/or modified sequence opt1 from anti-influenza_CDR
  source 1..57: mol_type = other RNA
gcccgccactacccctactacgacctgccgaccggcttctacagccagttcgacttc

SEQ ID NO: 15067 - RNA, 57 nt, synthetic construct
  misc_feature 1..57: note = derived and/or modified sequence opt1 from anti-influenza_CDR
  source 1..57: mol_type = other RNA
ggcagcgggggctacgggggcttcgactacttcgggaagctgcgcacctgggacttc

SEQ ID NO: 15068 - RNA, 57 nt, synthetic construct
  misc_feature 1..57: note = derived and/or modified sequence opt1 from anti-influenza_CDR
  source 1..57: mol_type = other RNA
ttcatccgcacccggccctggggcgggaccgccgacacggccgcgagcgtgaagggc

SEQ ID NO: 15069 - RNA, 57 nt, synthetic construct
  misc_feature 1..57: note = derived and/or modified sequence opt1 from anti-influenza_CDR
  source 1..57: mol_type = other RNA
ctgaactaccacgacagcggcacctactacaacgccccgcgcgggtggttcgacccc

SEQ ID NO: 15070 - RNA, 57 nt, synthetic construct
  misc_feature 1..57: note = derived and/or modified sequence opt1 from anti-influenza_CDR
  source 1..57: mol_type = other RNA
gtgaaggacggctactgcaccctgaccagctgccccgtcgggtggtacttcgacctc

SEQ ID NO: 15071 - RNA, 57 nt, synthetic construct
  misc_feature 1..57: note = derived and/or modified sequence opt1 from anti-influenza_CDR
  source 1..57: mol_type = other RNA
gccgtgcccggccccatcttcgggatcttcccgccctggagctacttcgaccactgg

SEQ ID NO: 15072 - RNA, 57 nt, synthetic construct
  misc_feature 1..57: note = derived and/or modified sequence opt1 from anti-influenza_CDR
  source 1..57: mol_type = other RNA
gcccgcgccatgatccagggcgtggtcaccctgtacctccggcccggggactactgg

SEQ ID NO: 15073 - RNA, 57 nt, synthetic construct
  misc_feature 1..57: note = derived and/or modified sequence opt1 from anti-influenza_CDR
  source 1..57: mol_type = other RNA
gccaaggtgggcccctacaccgggtacgacgactacaactactacggcatggacgtc

SEQ ID NO: 15074 - RNA, 57 nt, synthetic construct
  misc_feature 1..57: note = derived and/or modified sequence opt1 from anti-influenza_CDR
  source 1..57: mol_type = other RNA
gccaaggtggagcgcagcttctacgacggctccgggtacggcgacgccctggagatc

SEQ ID NO: 15075 - RNA, 57 nt, synthetic construct
  misc_feature 1..57: note = derived and/or modified sequence opt1 from anti-influenza_CDR
  source 1..57: mol_type = other RNA
tactgcgcccgcggccgggtgaacagcgggtacgactggggccccaacttcgactcc

SEQ ID NO: 15076 - RNA, 57 nt, synthetic construct
  misc_feature 1..57: note = derived and/or modified sequence opt1 from anti-influenza_CDR
  source 1..57: mol_type = other RNA
ttctgcgcccgcggcagccccaactccgggtacgactggggcccgcacttcgactac

SEQ ID NO: 15077 - RNA, 57 nt, synthetic construct
  misc_feature 1..57: note = derived and/or modified sequence opt1 from anti-influenza_CDR
  source 1..57: mol_type = other RNA
cgcatcaagagcaacaccgacggcgggaccacggactacgccgcccccgtgaagggc

SEQ ID NO: 15078 - RNA, 57 nt, synthetic construct
  misc_feature 1..57: note = derived and/or modified sequence opt1 from anti-influenza_CDR
  source 1..57: mol_type = other RNA
ctgcgcctccagggcgaggtggtcgtgcccccgagccagtccaactggttcgacccc

SEQ ID NO: 15079 - RNA, 60 nt, synthetic construct
  misc_feature 1..60: note = derived and/or modified sequence opt1 from anti-influenza_CDR
  source 1..60: mol_type = other RNA
gccaaggagggcgggaacaccatcttcggcctggtgaccatggcctactacttcgacagc

SEQ ID NO: 15080 - RNA, 60 nt, synthetic construct
  misc_feature 1..60: note = derived and/or modified sequence opt1 from anti-influenza_CDR
  source 1..60: mol_type = other RNA
gcccgcgccggcggggacagctccggctactacggggcgctgggccggttcttccagcac

SEQ ID NO: 15081 - RNA, 60 nt, synthetic construct
  misc_feature 1..60: note = derived and/or modified sequence opt1 from anti-influenza_CDR
  source 1..60: mol_type = other RNA
gccaaggacagccgcggctactgctccagcatcatctgcttcgagggcgggctggacaac

SEQ ID NO: 15082 - RNA, 60 nt, synthetic construct
  misc_feature 1..60: note = derived and/or modified sequence opt1 from anti-influenza_CDR
  source 1..60: mol_type = other RNA
ggcagcgggtccagcgaccgctccgactacgacccccactactactactacctggacgtg

SEQ ID NO: 15083 - RNA, 60 nt, synthetic construct
  misc_feature 1..60: note = derived and/or modified sequence opt1 from anti-influenza_CDR
  source 1..60: mol_type = other RNA
ggcaccgaccccgacaccgaggtgtactgccgcgtcgggaactgcgccgccttcgactac

SEQ ID NO: 15084 - RNA, 60 nt, synthetic construct
  misc_feature 1..60: note = derived and/or modified sequence opt1 from anti-influenza_CDR
  source 1..60: mol_type = other RNA
ggcaccagccacgtgtcccgctacttcgactggctgcccccgaccaactggttcgacccc

SEQ ID NO: 15085 - RNA, 60 nt, synthetic construct
  misc_feature 1..60: note = derived and/or modified sequence opt1 from anti-influenza_CDR
  source 1..60: mol_type = other RNA
ggcaccgaccccgacaccgaggggtactgccgcagcggctcctgcagcgccttcgacttc

SEQ ID NO: 15086 - RNA, 60 nt, synthetic construct
  misc_feature 1..60: note = derived and/or modified sequence opt1 from anti-influenza_CDR
  source 1..60: mol_type = other RNA
ggcaccgaccccgacaccgaggtgtactgccgcgccgggaactgcgccgcgttcgacttc

SEQ ID NO: 15087 - RNA, 60 nt, synthetic construct
  misc_feature 1..60: note = derived and/or modified sequence opt1 from anti-influenza_CDR
  source 1..60: mol_type = other RNA
cgcggcgggcacagcttcggctacgggtccggcggggacacccacagcgagttcgactcc

SEQ ID NO: 15088 - RNA, 60 nt, synthetic construct
  misc_feature 1..60: note = derived and/or modified sequence opt1 from anti-influenza_CDR
  source 1..60: mol_type = other RNA
cacatgagcatgcagcaggtcgtgtccgccggctgggagcgcgccgacctggtgggggac

SEQ ID NO: 15089 - RNA, 60 nt, synthetic construct
  misc_feature 1..60: note = derived and/or modified sequence opt1 from anti-influenza_CDR
  source 1..60: mol_type = other RNA
gacagccgcctgcggtccctcctgtacttcgagtggctgagccagggctacttcaacccc

SEQ ID NO: 15090 - RNA, 60 nt, synthetic construct
  misc_feature 1..60: note = derived and/or modified sequence opt1 from anti-influenza_CDR
  source 1..60: mol_type = other RNA
gcccgccacctgggccagcagctcgtgagcaacacctactactactacgggatggacgtc

SEQ ID NO: 15091 - RNA, 63 nt, synthetic construct
  misc_feature 1..63: note = derived and/or modified sequence opt1 from anti-influenza_CDR
  source 1..63: mol_type = other RNA
accaccggcgggaccacgacctgcaccgccgccggctgcgggggcgggtgctgcacgtgctgc

SEQ ID NO: 15092 - RNA, 63 nt, synthetic construct
  misc_feature 1..63: note = derived and/or modified sequence opt1 from anti-influenza_CDR
  source 1..63: mol_type = other RNA
gcccgcgccgcggacgagagcgtggagtccctgaccatcaaggccttccggaccaactaccac

SEQ ID NO: 15093 - RNA, 63 nt, synthetic construct
  misc_feature 1..63: note = derived and/or modified sequence opt1 from anti-influenza_CDR
  source 1..63: mol_type = other RNA
gcccgcatgcccctggccaactacgacctcctgaccggcctgtacatcggggcgttcgacctc

SEQ ID NO: 15094 - RNA, 63 nt, synthetic construct
  misc_feature 1..63: note = derived and/or modified sequence opt1 from anti-influenza_CDR
  source 1..63: mol_type = other RNA
gacatgctggcctactacagcgacaactccggcaagaagtacaacgtgtacgggatggacgtc

SEQ ID NO: 15095 - RNA, 63 nt, synthetic construct
  misc_feature 1..63: note = derived and/or modified sequence opt1 from anti-influenza_CDR
  source 1..63: mol_type = other RNA
gacatgctggcctactactacgacggcagcgggatccgctacaacctctacggcatggacgtg

SEQ ID NO: 15096 - RNA, 66 nt, synthetic construct
  misc_feature 1..66: note = derived and/or modified sequence opt1 from anti-influenza_CDR
  source 1..66: mol_type = other RNA
gccaaggacccccgcctgcggcacctcctgtacttcccgttcaccagcatgatctacttcgactac

SEQ ID NO: 15097 - RNA, 66 nt, synthetic construct
  misc_feature 1..66: note = derived and/or modified sequence opt1 from anti-influenza_CDR
  source 1..66: mol_type = other RNA
gccaaggacagccagctgcgctccctcctgtacttcgagtggctgagccagggctacttcgacccc

SEQ ID NO: 15098 - RNA, 66 nt, synthetic construct
  misc_feature 1..66: note = derived and/or modified sequence opt1 from anti-influenza_CDR
  source 1..66: mol_type = other RNA
gccaaggacagccagctgcgctccctcctgtacttcgagtggctgagccagggctacttcgactac

SEQ ID NO: 15099 - RNA, 66 nt, synthetic construct
  misc_feature 1..66: note = derived and/or modified sequence opt1 from anti-influenza_CDR
  source 1..66: mol_type = other RNA
gccaaggacagccagctgcgctccctcctgtacttcgagtggctgagccagggctacttcgagccc

SEQ ID NO: 15100 - RNA, 66 nt, synthetic construct
  misc_feature 1..66: note = derived and/or modified sequence opt1 from anti-influenza_CDR
  source 1..66: mol_type = other RNA
gccaaggagcgccccctgcggctcctgcgctacttcgactggctgagcggcggggccaacgactac

SEQ ID NO: 15101 - RNA, 66 nt, synthetic construct
  misc_feature 1..66: note = derived and/or modified sequence opt1 from anti-influenza_CDR
  source 1..66: mol_type = other RNA
gcccgcgacgtgcacaactacgacttcctgaccggctaccccctccacctgtacgggatggacgtc

SEQ ID NO: 15102 - RNA, 66 nt, synthetic construct
  misc_feature 1..66: note = derived and/or modified sequence opt1 from anti-influenza_CDR
  source 1..66: mol_type = other RNA
gcccgcgacggccgggaggggtacttctacggcagcgggtccttctacaacctgaagggcctcaac

SEQ ID NO: 15103 - RNA, 66 nt, synthetic construct
  misc_feature 1..66: note = derived and/or modified sequence opt1 from anti-influenza_CDR
  source 1..66: mol_type = other RNA
agcaccgaccgcggccacgtgctgcggtacttcgggtggatgctccccggcgacgccttcgacgtc

SEQ ID NO: 15104 - RNA, 66 nt, synthetic construct
  misc_feature 1..66: note = derived and/or modified sequence opt1 from anti-influenza_CDR
  source 1..66: mol_type = other RNA
ctgaactactacgaccgcagcggctaccactcccccgacgggccgagcaacaactggttcgacccc

SEQ ID NO: 15105 - RNA, 66 nt, synthetic construct
  misc_feature 1..66: note = derived and/or modified sequence opt1 from anti-influenza_CDR
  source 1..66: mol_type = other RNA
gcccgcgtgccccgggaccgcctgctcaccctgtactacgagagctccacctacggcttcgactac

SEQ ID NO: 15106 - RNA, 66 nt, synthetic construct
  misc_feature 1..66: note = derived and/or modified sequence opt1 from anti-influenza_CDR
  source 1..66: mol_type = other RNA
gcccgcaagtggggccggatgaccgtgttcggggtcgccaccgaccagctgtactacttcgactac

SEQ ID NO: 15107 - RNA, 66 nt, synthetic construct
  misc_feature 1..66: note = derived and/or modified sequence opt1 from anti-influenza_CDR
  source 1..66: mol_type = other RNA
gccaccgacatcgtggtcgagcgcgacgccagcctgggcgggttcaactcctacggcatggacgtg

SEQ ID NO: 15108 - RNA, 69 nt, synthetic construct
  misc_feature 1..69: note = derived and/or modified sequence opt1 from anti-influenza_CDR
  source 1..69: mol_type = other RNA
gcccgcaacctgcccgacatcgccgtggtcaccgcggtgcaggacgccaccccggtgtggttcgacccc

SEQ ID NO: 15109 - RNA, 69 nt, synthetic construct
  misc_feature 1..69: note = derived and/or modified sequence opt1 from anti-influenza_CDR
  source 1..69: mol_type = other RNA
gacggcccctacagcgacgacttccgctccgggtacgccgcccggtaccgctacttcggcatggacgtg

SEQ ID NO: 15110 - RNA, 72 nt, synthetic construct
  misc_feature 1..72: note = derived and/or modified sequence opt1 from anti-influenza_CDR
  source 1..72: mol_type = other RNA
ggccgcgagctgctccggctgcagcacttcctgaccgacagccagtccgagcgccgggactgcttcgacccc

SEQ ID NO: 15111 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacgagtggggctgccggtgcaacgactccagcgac

SEQ ID NO: 15112 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgaagaacgagtgggagtgccgctgcaacgactccagcgac

SEQ ID NO: 15113 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtgggagtgccggtgcaacgactccagcgac

SEQ ID NO: 15114 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacggctgggagtgcaagtgcaacgactccagcgac

SEQ ID NO: 15115 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgctccgagtggggctgccggtgcaacgacagctccgac

SEQ ID NO: 15116 - RNA, 72 nt, synthetic construct
  misc_feature 1..72: note = derived and/or modified sequence opt1 from anti-influenza_CDR
  source 1..72: mol_type = other RNA
atgagcttcctgcccgaggtggagaccccgatccgcaacgagtggggctgccggtgcaacgactccagcgac

SEQ ID NO: 15117 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtggggctgccggtgcaacgactccagcaac

SEQ ID NO: 15118 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaaggagtggggctgccggtgcaacgactccagcgac

SEQ ID NO: 15119 - RNA, 72 nt, synthetic construct
  misc_feature 1..72: note = derived and/or modified sequence opt1 from anti-influenza_CDR
  source 1..72: mol_type = other RNA
atgagcttcctgaccgaggtggagacccccatccgcaacgagtggggctgccggtgcaacgactccagcgac

SEQ ID NO: 15120 - RNA, 72 nt, synthetic construct
  misc_feature 1..72: note = derived and/or modified sequence opt1 from anti-influenza_CDR
  source 1..72: mol_type = other RNA
atgagcctgcccaccgaggtggagaccccgatccgctccgagtggggctgccggtgcaacgacagctccgac

SEQ ID NO: 15121 - RNA, 72 nt, synthetic construct
  misc_feature 1..72: note = derived and/or modified sequence opt1 from anti-influenza_CDR
  source 1..72: mol_type = other RNA
atgagcctgctccccgaggtggagaccccgatccgcaacgagtggggctgccggtgcaacgactccagcgac

SEQ ID NO: 15122 - RNA, 72 nt, synthetic construct
  misc_feature 1..72: note = derived and/or modified sequence opt1 from anti-influenza_CDR
  source 1..72: mol_type = other RNA
atgagcctgctccccgaggtggagaccccgatccgcaacggctgggggtgccggtgcaacgactccagcgac

SEQ ID NO: 15123 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacggctgggagtgccggtgctccgggagctccgac

SEQ ID NO: 15124 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtgggagtaccggtgcaacgactccagcgac

SEQ ID NO: 15125 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtgggagtaccggtgctccgacagctccgac

SEQ ID NO: 15126 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacggctgggagtgccggtactccgacagctccgac

SEQ ID NO: 15127 - RNA, 72 nt, synthetic construct
  misc_feature 1..72: note = derived and/or modified sequence opt1 from anti-influenza_CDR
  source 1..72: mol_type = other RNA
atgagcttcctgaccgaggtggagaccctcacgcgcaacggctgggagtgccggtgctccgacagctccgac

SEQ ID NO: 15128 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagaccctgacgcgcaacggctgggagtgcaagtgccgggactccagcgac

SEQ ID NO: 15129 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtggggctgccggtgcaacgactccagcgac

SEQ ID NO: 15130 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgctccgagtggggctgccggtgcaacgacagcggggac

SEQ ID NO: 15131 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtgggagtgccggtgcaacggctccagcgac

SEQ ID NO: 15132 - RNA, 72 nt, synthetic construct
  misc_feature 1..72: note = derived and/or modified sequence opt1 from anti-influenza_CDR
  source 1..72: mol_type = other RNA
atgagcctgcccaccgaggtggagaccccgatccgcaacgagtggggctgccggtgcaacgactccagcgac

SEQ ID NO: 15133 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtggggctgccggtgcaacgggtccagcgac

SEQ ID NO: 15134 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggacaccctgacgcgcaacggctgggggtgccggtgctccgacagctccgac

SEQ ID NO: 15135 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagaccctgacgaagaacggctgggggtgccgctgctccgacagctccgac

SEQ ID NO: 15136 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacggctgggagtgcaagtgctccgacagctccgac

SEQ ID NO: 15137 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccacacgcgcaacggctgggagtgcaagtgctccgacagctccgac

SEQ ID NO: 15138 - RNA, 72 nt, synthetic construct
  misc_feature 1..72: note = derived and/or modified sequence opt1 from anti-influenza_CDR
  source 1..72: mol_type = other RNA
atgagcctgctcaccgaggtgaagacccccacgcgcaacggctgggagtgcaagtgctccgacagctccgac

SEQ ID NO: 15139 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagaccctgacgcgcaacggctgggggtgccggtgctccgacagctccgac

SEQ ID NO: 15140 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcgacggctgggagtgcaagtgctccgacagctccgac

SEQ ID NO: 15141 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacggctgggggtgccggtgctccgacagctccgac

SEQ ID NO: 15142 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacggctgggagtgcaagtgcaacgactccagcgac

SEQ ID NO: 15143 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagaccctgacgcgcaacggctgggagtgcaagtgctccgacagctccgac

SEQ ID NO: 15144 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaacgagtggggctgcaagtgcaacgactccagcgac

SEQ ID NO: 15145 - RNA, 72 nt, synthetic construct
  misc_feature 1..72: note = derived and/or modified sequence opt1 from anti-influenza_CDR
  source 1..72: mol_type = other RNA
atgagcttcctgaccgaggtggagacccccatccgcaacgagtggggctgccggtgcaacgggtccagcgac

SEQ ID NO: 15146 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacggctgggagtgccggtgcaacgactccagcgac

SEQ ID NO: 15147 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccatccgcaagggctgggagtgcaactgctccgacagctccgac

SEQ ID NO: 15148 - RNA, 72 nt, synthetic construct
  misc_feature 1..72: note = derived and/or modified sequence opt1 from anti-influenza_CDR
  source 1..72: mol_type = other RNA
atgagcctgctcaccgaggtggagacccccacgcgcaacgagtgggagtgccggtgctccgacagctccgac

SEQ ID NO: 15149 - RNA, 72 nt, synthetic construct
  misc_feature 1..72: note = derived and/or modified sequence opt1 from anti-influenza_CDR
  source 1..72: mol_type = other RNA
atgagcctgctcaccggcgtggagacccacacgcgcaacgggtggggctgcaagtgctccgacagctccgac

SEQ ID NO: 15150 - RNA, 72 nt, synthetic construct
  misc_feature 1..72: note = derived and/or modified sequence opt1 from anti-influenza_CDR
  source 1..72: mol_type = other RNA
atgagcctgctccccgaggtggagacccacacccgcaacggctgggggtgccggtgctccgacagctccgac

SEQ ID NO: 15151 - RNA, 72 nt, synthetic construct
  misc_feature 1..72: note = derived and/or modified sequence opt1 from anti-influenza_CDR
  source 1..72: mol_type = other RNA
accgacggcccctacagcgacgacttccgctccgggtacgccgcccggtaccgctacttcggcatggacgtg

SEQ ID NO: 15152 - RNA, 75 nt, synthetic construct
  misc_feature 1..75: note = derived and/or modified sequence opt1 from anti-influenza_CDR
  source 1..75: mol_type = other RNA
gccaagcacatgagcctgcagcaggtcgtgtccgccggctgggagcgcgcggacctcgtgggggacgccttcgac

SEQ ID NO: 15153 - RNA, 75 nt, synthetic construct
  misc_feature 1..75: note = derived and/or modified sequence opt1 from anti-influenza_CDR
  source 1..75: mol_type = other RNA
gccaagcacctgagcatgcagcaggtcgtgtccgccggctgggagcgcgcggacctcgtgggggacgccttcgac

SEQ ID NO: 15154 - RNA, 75 nt, synthetic construct
  misc_feature 1..75: note = derived and/or modified sequence opt1 from anti-influenza_CDR
  source 1..75: mol_type = other RNA
gccaagcacgccagcctgcagcaggtcgtgtccgcgggctgggagcgcgccgacctcgtgggggacgccttcgac

SEQ ID NO: 15155 - RNA, 75 nt, synthetic construct
  misc_feature 1..75: note = derived and/or modified sequence opt1 from anti-influenza_CDR
  source 1..75: mol_type = other RNA
gccaagcacagctccctgcagcaggtcgtgagcgccggctgggagcgcgcggacctcgtgggggacgccttcgac

SEQ ID NO: 15156 - RNA, 75 nt, synthetic construct
  misc_feature 1..75: note = derived and/or modified sequence opt1 from anti-influenza_CDR
  source 1..75: mol_type = other RNA
gccaagcacctgagcctccagcaggtcgtgtccgccggctgggagcgcgcggacctggtgggggacgccttcgac

SEQ ID NO: 15157 - RNA, 75 nt, synthetic construct
  misc_feature 1..75: note = derived and/or modified sequence opt1 from anti-influenza_CDR
  source 1..75: mol_type = other RNA
gccaagcacatgagcatgcagcaggtcgtgtccgccggctgggagcgcgcggacctggtgggggacgccttcgac

SEQ ID NO: 15158 - RNA, 75 nt, synthetic construct
  misc_feature 1..75: note = derived and/or modified sequence opt1 from anti-influenza_CDR
  source 1..75: mol_type = other RNA
gcccgcggccccgagacctactactacgacaagaccaactggctgaacagccacccggacgagtacttccagcac

SEQ ID NO: 15159 - RNA, 75 nt, synthetic construct
  misc_feature 1..75: note = derived and/or modified sequence opt1 from anti-influenza_CDR
  source 1..75: mol_type = other RNA
accaccgacggcccctacagcgacgacttccgctccgggtacgccgcccggtaccgctacttcggcatggacgtg

SEQ ID NO: 15160 - RNA, 75 nt, synthetic construct
  misc_feature 1..75: note = derived and/or modified sequence opt1 from anti-influenza_CDR
  source 1..75: mol_type = other RNA
accgacggcccctacagcgacgacttccgctccgggtacgccgcccggtaccgctacttcggcatggacgtgtgg

SEQ ID NO: 15161 - RNA, 78 nt, synthetic construct
  misc_feature 1..78: note = derived and/or modified sequence opt1 from anti-influenza_CDR
  source 1..78: mol_type = other RNA
gacatccagatgacccagagcccctccagcctgtccgccagcgtgggcgaccgcgtcaccatcacgtgccggtccagc

SEQ ID NO: 15162 - RNA, 78 nt, synthetic construct
  misc_feature 1..78: note = derived and/or modified sequence opt1 from anti-influenza_CDR
  source 1..78: mol_type = other RNA
gccaccggccgcgccgcgaccgggagcgcctcctgcacgggcgggggcacctactggacctactgcacgtgcaccacc

SEQ ID NO: 15163 - RNA, 81 nt, synthetic construct
  misc_feature 1..81: note = derived and/or modified sequence opt1 from anti-influenza_CDR
  source 1..81: mol_type = other RNA
ggctacatccccgaggccccgcgcgacgggcaggcctacgtgcggaaggacggcgagtgggtcctgctcagcaccttcctg

SEQ ID NO: 15164 - RNA, 90 nt, synthetic construct
  misc_feature 1..90: note = derived and/or modified sequence opt1 from anti-influenza_CDR
  source 1..90: mol_type = other RNA
caggtgcagctgctcgagaccggcgggggcctggtcaagcccgggcagagcctgaagctctcctgcgccgccagcggcttcaccttcacg

SEQ ID NO: 15165 - RNA, 96 nt, synthetic construct
  misc_feature 1..96: note = derived and/or modified sequence opt1 from anti-influenza_CDR
  source 1..96: mol_type = other RNA
cgcttcaccatcagccgggacaactccaagaacaccctgtacctccagatgaacagcctgcgcgccgaggacacggccgtgtactactgcgcgaag

SEQ ID NO: 15166 - RNA, 96 nt, synthetic construct
  misc_feature 1..96: note = derived and/or modified sequence opt1 from anti-influenza_CDR
  source 1..96: mol_type = other RNA
ggcgtgcccagccgcttctccgggagcggctccgggaccgacttcaccctgacgatcagctccctccagccggaggacttcgccacctactactgc

SEQ ID NO: 15167 - RNA, 15 nt, synthetic construct
  misc_feature 1..15: note = derived and/or modified sequence opt1 from anti-OX40_HeavyChain_CDR1
  source 1..15: mol_type = other RNA
agctactccatgaac

SEQ ID NO: 15168 - RNA, 15 nt, synthetic construct
  misc_feature 1..15: note = derived and/or modified sequence opt1 from anti-OX40_HeavyChain_CDR1
  source 1..15: mol_type = other RNA
gactacgccatgcac

SEQ ID NO: 15169 - RNA, 15 nt, synthetic construct
  misc_feature 1..15: note = derived and/or modified sequence opt1 from anti-OX40_HeavyChain_CDR1
  source 1..15: mol_type = other RNA
gacagctacatgtcc

SEQ ID NO: 15170 - RNA, 15 nt, synthetic construct
  misc_feature 1..15: note = derived and/or modified sequence opt1 from anti-OX40_HeavyChain_CDR1
  source 1..15: mol_type = other RNA
gacgcctacatgagc

SEQ ID NO: 15171 - RNA, 15 nt, synthetic construct
  misc_feature 1..15: note = derived and/or modified sequence opt1 from anti-OX40_HeavyChain_CDR1
  source 1..15: mol_type = other RNA
gagagctacatgtcc

SEQ ID NO: 15172 - RNA, 15 nt, synthetic construct
  misc_feature 1..15: note = derived and/or modified sequence opt1 from anti-OX40_HeavyChain_CDR1
  source 1..15: mol_type = other RNA
agcggctactggaac

SEQ ID NO: 15173 - RNA, 21 nt, synthetic construct
  misc_feature 1..21: note = derived and/or modified sequence opt1 from anti-OX40_LightChain_CDR2
  source 1..21: mol_type = other RNA
tacaccagccgcctgcactcc

SEQ ID NO: 15174 - RNA, 21 nt, synthetic construct
  misc_feature 1..21: note = derived and/or modified sequence opt1 from anti-OX40_LightChain_CDR2
  source 1..21: mol_type = other RNA
gccgccagctccctgcagagc

SEQ ID NO: 15175 - RNA, 21 nt, synthetic construct
  misc_feature 1..21: note = derived and/or modified sequence opt1 from anti-OX40_LightChain_CDR2
  source 1..21: mol_type = other RNA
gacgccagcaaccgcgccacc

SEQ ID NO: 15176 - RNA, 21 nt, synthetic construct
  misc_feature 1..21: note = derived and/or modified sequence opt1 from anti-OX40_LightChain_CDR2
  source 1..21: mol_type = other RNA
tacaccagccgcctgcggtcc

SEQ ID NO: 15177 - RNA, 24 nt, synthetic construct
  misc_feature 1..24: note = derived and/or modified sequence opt1 from anti-OX40_LightChain_CDR3
  source 1..24: mol_type = other RNA
cagcagcgcagcaactggcccacc

SEQ ID NO: 15178 - RNA, 24 nt, synthetic construct
  misc_feature 1..24: note = derived and/or modified sequence opt1 from anti-OX40_HeavyChain_CDR3
  source 1..24: mol_type = other RNA
gccccccgctggtacttcagcgtg

SEQ ID NO: 15179 - RNA, 24 nt, synthetic construct
  misc_feature 1..24: note = derived and/or modified sequence opt1 from anti-OX40_HeavyChain_CDR3
  source 1..24: mol_type = other RNA
gccccccgctggtacttcagcgcc

SEQ ID NO: 15180 - RNA, 24 nt, synthetic construct
  misc_feature 1..24: note = derived and/or modified sequence opt1 from anti-OX40_HeavyChain_CDR3
  source 1..24: mol_type = other RNA
gccccccgctggtacttcgccgtg

SEQ ID NO: 15181 - RNA, 27 nt, synthetic construct
  misc_feature 1..27: note = derived and/or modified sequence opt1 from anti-OX40_LightChain_CDR3
  source 1..27: mol_type = other RNA
cagcagggcaacaccctgccctggacc

SEQ ID NO: 15182 - RNA, 27 nt, synthetic construct
  misc_feature 1..27: note = derived and/or modified sequence opt1 from anti-OX40_HeavyChain_CDR3
  source 1..27: mol_type = other RNA
gagagcggctggtacctgttcgactac

SEQ ID NO: 15183 - RNA, 27 nt, synthetic construct
  misc_feature 1..27: note = derived and/or modified sequence opt1 from anti-OX40_LightChain_CDR3
  source 1..27: mol_type = other RNA
cagcagtacaacagctacccgcccacc

SEQ ID NO: 15184 - RNA, 27 nt, synthetic construct
  misc_feature 1..27: note = derived and/or modified sequence opt1 from anti-OX40_LightChain_CDR3
  source 1..27: mol_type = other RNA
cagcagggccacaccctgcccccgacc

SEQ ID NO: 15185 - RNA, 27 nt, synthetic construct
  misc_feature 1..27: note = derived and/or modified sequence opt1 from anti-OX40_LightChain_CDR3
  source 1..27: mol_type = other RNA
cagcagggccacaccctgcccgccacc

SEQ ID NO: 15186 - RNA, 27 nt, synthetic construct
  misc_feature 1..27: note = derived and/or modified sequence opt1 from anti-OX40_LightChain_CDR3
  source 1..27: mol_type = other RNA
cagcagggccacaccgccccgcccacc

SEQ ID NO: 15187 - RNA, 27 nt, synthetic construct
  misc_feature 1..27: note = derived and/or modified sequence opt1 from anti-OX40_LightChain_CDR3
  source 1..27: mol_type = other RNA
cagcagggcgccaccctgcccccgacc

SEQ ID NO: 15188 - RNA, 27 nt, synthetic construct
  misc_feature 1..27: note = derived and/or modified sequence opt1 from anti-OX40_LightChain_CDR3
  source 1..27: mol_type = other RNA
cagcagggccacgccctgcccccgacc

SEQ ID NO: 15189 - RNA, 27 nt, synthetic construct
  misc_feature 1..27: note = derived and/or modified sequence opt1 from anti-OX40_LightChain_CDR3
  source 1..27: mol_type = other RNA
cagcaggcccacaccctgcccccgacc

SEQ ID NO: 15190 - RNA, 27 nt, synthetic construct
  misc_feature 1..27: note = derived and/or modified sequence opt1 from anti-OX40_LightChain_CDR3
  source 1..27: mol_type = other RNA
cagcagggccacaccctggcccccacc

SEQ ID NO: 15191 - RNA, 27 nt, synthetic construct
  misc_feature 1..27: note = derived and/or modified sequence opt1 from anti-OX40_LightChain_CDR3
  source 1..27: mol_type = other RNA
caggccggccacaccctgcccccgacc

SEQ ID NO: 15192 - RNA, 30 nt, synthetic construct
  misc_feature 1..30: note = derived and/or modified sequence opt1 from anti-OX40_HeavyChain_CDR1
  source 1..30: mol_type = other RNA
ggctacaccttcaccagctacgtgatgcac

SEQ ID NO: 15193 - RNA, 30 nt, synthetic construct
  misc_feature 1..30: note = derived and/or modified sequence opt1 from anti-OX40_HeavyChain_CDR3
  source 1..30: mol_type = other RNA
tactacggcagctccctgagcatggactac

SEQ ID NO: 15194 - RNA, 33 nt, synthetic construct
  misc_feature 1..33: note = derived and/or modified sequence opt1 from anti-OX40_LightChain_CDR1
  source 1..33: mol_type = other RNA
cgcgccagccaggacatctccaactacctgaac

SEQ ID NO: 15195 - RNA, 33 nt, synthetic construct
  misc_feature 1..33: note = derived and/or modified sequence opt1 from anti-OX40_LightChain_CDR1
  source 1..33: mol_type = other RNA
cgcgccagccagggcatctccagctggctggcc

SEQ ID NO: 15196 - RNA, 33 nt, synthetic construct; identical to SEQ ID NO: 14714
  misc_feature 1..33: note = derived and/or modified sequence opt1 from anti-OX40_LightChain_CDR1
  source 1..33: mol_type = other RNA

SEQ ID NO: 15197 - RNA, 39 nt, synthetic construct
  misc_feature 1..39: note = derived and/or modified sequence opt1 from anti-OX40_HeavyChain_CDR3
  source 1..39: mol_type = other RNA
taccgctacgactacgacggcgggcacgccatggactac

SEQ ID NO: 15198 - RNA, 39 nt, synthetic construct
  misc_feature 1..39: note = derived and/or modified sequence opt1 from anti-OX40_HeavyChain_CDR3
  source 1..39: mol_type = other RNA
tacaagtacgactacgacgccggccacgccatggactac

SEQ ID NO: 15199 - RNA, 39 nt, synthetic construct
  misc_feature 1..39: note = derived and/or modified sequence opt1 from anti-OX40_HeavyChain_CDR3
  source 1..39: mol_type = other RNA
tacaagtacgactacgacggcgggcacgccatggactac

SEQ ID NO: 15200 - RNA, 45 nt, synthetic construct
  misc_feature 1..45: note = derived and/or modified sequence opt1 from anti-OX40_HeavyChain_CDR3
  source 1..45: mol_type = other RNA
gaccagagcaccgccgactactacttctactacggcatggacgtg

SEQ ID NO: 15201 - RNA, 48 nt, synthetic construct
  misc_feature 1..48: note = derived and/or modified sequence opt1 from anti-OX40_HeavyChain_CDR2
  source 1..48: mol_type = other RNA
tacatcagctacaacggcatcacctaccacaaccccagcctgaagtcc

SEQ ID NO: 15202 - RNA, 48 nt, synthetic construct
  misc_feature 1..48: note = derived and/or modified sequence opt1 from anti-OX40_HeavyChain_CDR2
  source 1..48: mol_type = other RNA
tacatcagctacaacgccatcacctaccacaaccccagcctgaagtcc

SEQ ID NO: 15203 - RNA, 48 nt, synthetic construct
  misc_feature 1..48: note = derived and/or modified sequence opt1 from anti-OX40_HeavyChain_CDR2
  source 1..48: mol_type = other RNA
tacatcagctactccggcatcacctaccacaaccccagcctgaagtcc

SEQ ID NO: 15204 - RNA, 51 nt, synthetic construct
  misc_feature 1..51: note = derived and/or modified sequence opt1 from anti-OX40_HeavyChain_CDR2
  source 1..51: mol_type = other RNA
tacatcaacccctacaacgacggcaccaagtacaacgagaagttcaagggg

SEQ ID NO: 15205 - RNA, 51 nt, synthetic construct
  misc_feature 1..51: note = derived and/or modified sequence opt1 from anti-OX40_HeavyChain_CDR2
  source 1..51: mol_type = other RNA
tacatcagctccagctccagcaccatcgactacgccgactccgtgaagggc

SEQ ID NO: 15206 - RNA, 51 nt, synthetic construct
  misc_feature 1..51: note = derived and/or modified sequence opt1 from anti-OX40_HeavyChain_CDR2
  source 1..51: mol_type = other RNA
ggcatcagctggaactccgggagcatcggctacgccgactccgtgaagggg

SEQ ID NO: 15207 - RNA, 51 nt, synthetic construct
  misc_feature 1..51: note = derived and/or modified sequence opt1 from anti-OX40_HeavyChain_CDR2
  source 1..51: mol_type = other RNA
gacatgtaccccgacaacggcgacagctcctacaaccagaagttccgcgag

SEQ ID NO: 15208 - RNA, 51 nt, synthetic construct
  misc_feature 1..51: note = derived and/or modified sequence opt1 from anti-OX40_HeavyChain_CDR2
  source 1..51: mol_type = other RNA
gacatgtaccccgacaacgccgacagctcctacaaccagaagttccgcgag

SEQ ID NO: 15209 - RNA, 51 nt, synthetic construct
  misc_feature 1..51: note = derived and/or modified sequence opt1 from anti-OX40_HeavyChain_CDR2
  source 1..51: mol_type = other RNA
gacatgtaccccgacaacgccgacgccagctacaaccagaagttccgcgag

SEQ ID NO: 15210 - RNA, 51 nt, synthetic construct
  misc_feature 1..51: note = derived and/or modified sequence opt1 from anti-OX40_HeavyChain_CDR2
  source 1..51: mol_type = other RNA
gacatgtaccccgacaacggcgacgccagctacaaccagaagttccgcgag

SEQ ID NO: 15211 - RNA, 51 nt, synthetic construct
  misc_feature 1..51: note = derived and/or modified sequence opt1 from anti-OX40_HeavyChain_CDR2
  source 1..51: mol_type = other RNA
gacatgtaccccgacagcggcgactccagctacaaccagaagttccgcgag

SEQ ID NO: 15212 - RNA, 51 nt, synthetic construct
  misc_feature 1..51: note = derived and/or modified sequence opt1 from anti-OX40_HeavyChain_CDR2
  source 1..51: mol_type = other RNA
gacatgtaccccgacaacggcagctccagctacaaccagaagttccgcgag

SEQ ID NO: 15213 - RNA, 309 nt, synthetic construct
  misc_feature 1..309: note = derived and/or modified sequence opt1 from Ig_LightChain_kappa_constant_domain
  source 1..309: mol_type = other RNA
accgtggccgcccccagcgtcttcatcttcccgccctccgacgagcagctcaagagcggcaccgcgtccgtggtgtgcctgctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgg

SEQ ID NO: 15214 - RNA, 309 nt, synthetic construct
  misc_feature 1..309: note = derived and/or modified sequence opt1 from Ig_LightChain_kappa_constant_domain
  source 1..309: mol_type = other RNA
accgtggccgcccccagcgtcttcatcttcccgccctccgacgagcagctcaagagcggcaccgcgtccgtggtgtgcctgctgaacaacttctacccccgcgaggccaaggtccagtggaaggtggacaacgccctgcagagcgggaactcccaggagagcgtgacggagcaggactccaaggacagcacctactccctcagcaacaccctgaccctgtccaaggccgactacgagaagcacaaggtctacgcctgcgaggtgacgcaccagggcctcagctcccccgtgaccaagagcttcaaccgg

SEQ ID NO: 15215 - RNA, 312 nt, synthetic construct
  misc_feature 1..312: note = derived and/or modified sequence opt1 from Ig_LightChain_lambda_constant_domain
  source 1..312: mol_type = other RNA
cccaaggccgccccgagcgtgaccctgttcccgccctccagcgaggagctccaggcgaacaaggccaccctggtctgcctgatctccgacttctaccccggcgccgtgacggtggcctggaaggccgacagctcccccgtcaaggcgggggtggagaccaccacccccagcaagcagtccaacaacaagtacgccgccagctcctacctcagcctgacgcccgagcagtggaagtcccaccgcagctactcctgccaggtgacccacgagggcagcaccgtcgagaagaccgtggcccccacggagtgctcc

SEQ ID NO: 15216 - RNA, 312 nt, synthetic construct
  misc_feature 1..312: note = derived and/or modified sequence opt1 from Ig_LightChain_lambda_constant_domain
  source 1..312: mol_type = other RNA
cccaaggccgccccgagcgtgaccctgttcccgccctccagcgaggagctccaggcgaacaaggccaccctggtctgcctgatctccgacttctaccccggcgccgtgacggtggcctggaaggccgacagctcccccgtcaaggcgggggtggagaccaccacccccagcaagcagtccaacaacaagtacgccgccagctcctacctcagcctgacgcccgagcagtggaagtcccaccgcagctactcctgccaggtgacccacgagggcagcaccgtcgagaagaccgtggcccccgcggagtgctcc

SEQ ID NO: 15217 - RNA, 312 nt, synthetic construct
  misc_feature 1..312: note = derived and/or modified sequence opt1 from Ig_LightChain_lambda_constant_domain
  source 1..312: mol_type = other RNA
cccaaggccgccccgagcgtgaccctgttcccgccctccagcgaggagctccaggcgaacaaggccaccctggtctgcctgatctccgacttctaccccggcgccgtgacggtggcctggaaggccgacagctcccccgtcaaggcgggggtggagaccaccacccccagcaagcagtccaacaacaagtacgccgccagctcctacctcagcctgacgcccgagcagtggaagtcccacaagagctactcctgccaggtgacccacgagggcagcaccgtcgagaagaccgtggcccccacggagtgctcc

SEQ ID NO: 15218 - RNA, 312 nt, synthetic construct
  misc_feature 1..312: note = derived and/or modified sequence opt1 from Ig_LightChain_lambda_constant_domain
  source 1..312: mol_type = other RNA
cccaaggccgccccgagcgtgaccctgttcccgccctccagcgaggagctccaggcgaacaaggccaccctggtctgcctgatctccgacttctaccccggcgccgtgacggtggcctggaaggccgacagctcccccgtcaaggcgggggtggagaccaccacccccagcaagcagtccaacaacaagtacgccgccagctcctacctcagcctgacgcccgagcagtggaagtcccacaagagctactcctgccaggtgacccacgagggcagcaccgtcgagaagaccgtggcccccgcggagtgctcc

SEQ ID NO: 15219 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgttcccgctggccccctccagcaagtccaccagcgggggcacggcggccctcgggtgcctggtcaaggactacttccccgagcccgtgaccgtgtcctggaacagcggcgtccacaccttcccggccgtgctgcagtccagcgggctctactccctgagctccgtggtcaccgtgcccagctccagcctgggcacgcagacctacatctgcaacgtgaaccacaagccctccaacaccaaggtcgacaagaaggtg

SEQ ID NO: 15220 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgttcccgctggcccccagctccaagagcacctccgggggcaccgccgcgctcgggtgcctggtcaaggactacttccccgagcccgtgacggtgagctggaactccggcgtccacaccttcccggccgtgctgcagagctccgggctctacagcctgtccagcgtggtcaccgtgccctccagctccctgggcacccagacgtacatctgcaacgtgaaccacaagcccagcaacaccaaggtcgacaagaaggtg

SEQ ID NO: 15221 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgttcccgctggcccccagctccaagagcacctccgggggcaccgccgcgctcgggtgcctggtcaaggactacttccccgagcccgtgacggtgagctggaactccggcgtccacaccttcccggccgtgctgcagagctccgggctctacagcctgtccagcgtggtcaccgtgccctccagctccctgggcacccagacgtacatctgcaacgtgaaccacaagcccagcaacaccaaggtcgacaagaaggcc

SEQ ID NO: 15222 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgttcccgctggcccccagctccaagagcacctccgggggcaccgccgcgctcgggtgcctggtcaaggactacttccccgagcccgtgacggtgagctggaactccggcgtccacaccttcccggccgtgctgcagagctccgggctctacagcctgtccagcgtggtcaccgtgccctccagctccctgggcacccagacgtacatctgcaacgtgaaccacaagcccagcaacaccaaggtcgacaagcgcgtg

SEQ ID NO: 15223 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgttcccgctggcccccagctccaagagcacctccgggggcaccgccgcgctcgggtgcctggtcaaggactacttccccgagcccgtgacggtgagctggaactccggcgtccacaccttcccggccgtgctgcagagctccgggctctacagcctgtccagcgtggtcaccgtgccctccagctccctgggcacccagacgtacatctgcaacgtgaaccacaagcccagcaacaccaaggtcgacaagcgcgcc

SEQ ID NO: 15224 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgctgccgctcgcccccagctccaagagcacctccgggggcaccgccgcgctggggtgcctggtcaaggactacttccccgagcccgtgacggtgagctggaactccggcgtccacaccttcccggccgtgctccagagctccgggctgtacagcctgtccagcgtggtcaccgtgccctccagctccctcggcacccagacgtacatctgcaacgtgaaccacaagcccagcaacaccaaggtcgacaagaaggtg

SEQ ID NO: 15225 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgctgccgctcgcccccagctccaagagcacctccgggggcaccgccgcgctggggtgcctggtcaaggactacttccccgagcccgtgacggtgagctggaactccggcgtccacaccttcccggccgtgctccagagctccgggctgtacagcctgtccagcgtggtcaccgtgccctccagctccctcggcacccagacgtacatctgcaacgtgaaccacaagcccagcaacaccaaggtcgacaagaaggcc

SEQ ID NO: 15226 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgctgccgctcgcccccagctccaagagcacctccgggggcaccgccgcgctggggtgcctggtcaaggactacttccccgagcccgtgacggtgagctggaactccggcgtccacaccttcccggccgtgctccagagctccgggctgtacagcctgtccagcgtggtcaccgtgccctccagctccctcggcacccagacgtacatctgcaacgtgaaccacaagcccagcaacaccaaggtcgacaagcgcgtg

SEQ ID NO: 15227 - RNA, 270 nt, synthetic construct
  misc_feature 1..270: note = derived and/or modified sequence opt1 from IgG1_HeavyChain_CH1_constant_domain
  source 1..270: mol_type = other RNA
agcggcccctccgtgctgccgctcgcccccagctccaagagcacctccgggggcaccgccgcgctggggtgcctggtcaaggactacttccccgagcccgtgacggtgagctggaactccggcgtccacaccttcccggccgtgctccagagctccgggctgtacagcctgtccagcgtggtcaccgtgccctccagctccctcggcacccagacgtacatctgcaacgtgaaccacaagcccagcaacaccaaggtcgacaagcgcgcc

SEQ ID NO: 15228 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgttcccgctggccccctccagcaagtccaccagcgggggcacggcggccctcgggtgcctggtcaaggactacttccccgagcccgtgaccgtgtcctggaacagcggcgtccacaccttcccggccgtgctgcagtccagcgggctctactccctgagctccgtggtcaccgtgcccagctccagcctgggcacgcagacctacatctgcaacgtgaaccacaagccctccaacaccaaggtcgacaagaaggcc

SEQ ID NO: 15229 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgttcccgctggccccctccagcaagtccaccagcgggggcacggcggccctcgggtgcctggtcaaggactacttccccgagcccgtgaccgtgtcctggaacagcggcgtccacaccttcccggccgtgctgcagtccagcgggctctactccctgagctccgtggtcaccgtgcccagctccagcctgggcacgcagacctacatctgcaacgtgaaccacaagccctccaacaccaaggtcgacaagcgcgtg

SEQ ID NO: 15230 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgttcccgctggccccctccagcaagtccaccagcgggggcacggcggccctcgggtgcctggtcaaggactacttccccgagcccgtgaccgtgtcctggaacagcggcgtccacaccttcccggccgtgctgcagtccagcgggctctactccctgagctccgtggtcaccgtgcccagctccagcctgggcacgcagacctacatctgcaacgtgaaccacaagccctccaacaccaaggtcgacaagcgcgcc

SEQ ID NO: 15231 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgctgccgctcgccccctccagcaagtccaccagcgggggcacggcggccctggggtgcctggtcaaggactacttccccgagcccgtgaccgtgtcctggaacagcggcgtccacaccttcccggccgtgctccagtccagcgggctgtactccctgagctccgtggtcaccgtgcccagctccagcctcggcacgcagacctacatctgcaacgtgaaccacaagccctccaacaccaaggtcgacaagaaggtg

SEQ ID NO: 15232 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgctgccgctcgccccctccagcaagtccaccagcgggggcacggcggccctggggtgcctggtcaaggactacttccccgagcccgtgaccgtgtcctggaacagcggcgtccacaccttcccggccgtgctccagtccagcgggctgtactccctgagctccgtggtcaccgtgcccagctccagcctcggcacgcagacctacatctgcaacgtgaaccacaagccctccaacaccaaggtcgacaagaaggcc

SEQ ID NO: 15233 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgctgccgctcgccccctccagcaagtccaccagcgggggcacggcggccctggggtgcctggtcaaggactacttccccgagcccgtgaccgtgtcctggaacagcggcgtccacaccttcccggccgtgctccagtccagcgggctgtactccctgagctccgtggtcaccgtgcccagctccagcctcggcacgcagacctacatctgcaacgtgaaccacaagccctccaacaccaaggtcgacaagcgcgtg

SEQ ID NO: 15234 - RNA, 282 nt, synthetic construct
  misc_feature 1..282: note = derived and/or modified sequence opt1 from IgG1_HeavyChain_CH1_constant_domain
  source 1..282: mol_type = other RNA
agcgcctccaccaagggccccagcgtgctgccgctcgccccctccagcaagtccaccagcgggggcacggcggccctggggtgcctggtcaaggactacttccccgagcccgtgaccgtgtcctggaacagcggcgtccacaccttcccggccgtgctccagtccagcgggctgtactccctgagctccgtggtcaccgtgcccagctccagcctcggcacgcagacctacatctgcaacgtgaaccacaagccctccaacaccaaggtcgacaagcgcgcc

SEQ ID NO: 15235 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgggccgagcgtgttcctgttcccgcccaagcccaaggacaccctgatgatctcccgcacccccgaggtcacgtgcgtggtggtcgacgtgagccacgaggaccccgaggtgaagttcaactggtacgtcgacggcgtggaggtgcacaacgccaagaccaagccccgggaggagcagtacaactccacctaccgcgtcgtgagcgtgctcaccgtcctgcaccaggactggctgaacgggaaggagtacaagtgcaaggtgtccaacaaggcgctccccgccccgatcgagaagacgatcagcaaggccaag

SEQ ID NO: 15236 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgggccgagcgtgttcctgttcccgcccaagcccaaggacaccctgatgatctcccgcacccccgaggtcacgtgcgtggtggtcgacgtgagccacgaggaccccgaggtgaagttcaacgtctacgtggacggcgtggaggtccacaacgccaagaccaagccccgggaggagcagtacaactccacctaccgcgtggtgagcgtcctcaccgtgctgcaccaggactggctgaacgggaaggagtacaagtgcaaggtgtccaacaaggcgctccccgccccgatcgagaagacgatcagcaaggccaag

SEQ ID NO: 15237 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgggccgagcgtgttcctgttcccgcccaagcccaaggacaccctgatgatctcccgcacccccgaggtcacgtgcgtggtggtcgacgtgagccacgaggaccccgaggtgaagttcaacgtctacgtggacggcgtggaggtccacaacgccaagaccaagccccgggaggagcagtacgcgtccacctaccgcgtggtgagcgtcctcaccgtgctgcaccaggactggctgaacgggaaggagtacaagtgcaaggtgtccaacaaggccctccccgccccgatcgagaagacgatcagcaaggccaag

SEQ ID NO: 15238 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgggccgagcgtgttcctgttcccgcccaagcccaaggacaccctgatgatctcccgcacccccgaggtcacgtgcgtggtggtcgacgtgagccacgaggaccccgaggtgaagttcaactggtacgtcgacggcgtggaggtgcacaacgccaagaccaagccccgggaggagcagtacgcgtccacctaccgcgtcgtgagcgtgctcaccgtcctgcaccaggactggctgaacgggaaggagtacaagtgcaaggtgtccaacaaggccctccccgccccgatcgagaagacgatcagcaaggccaag

SEQ ID NO: 15239 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgccccgagcgtgttcctgttcccgcccaagcccaaggacaccctgatgatctcccgcacccccgaggtcacgtgcgtggtggtcgacgtgagccacgaggaccccgaggtgaagttcaacgtctacgtggacggggtggaggtccacaacgcgaagaccaagccccgggaggagcagtacaactccacctaccgcgtggtgagcgtcctcaccgtgctgcaccaggactggctgaacggcaaggagtacaagtgcaaggtgtccaacaaggccctccccgccccgatcgagaagacgatcagcaaggccaag

SEQ ID NO: 15240 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgccccgagcgtgttcctgttcccgcccaagcccaaggacaccctgatgatctcccgcacccccgaggtcacgtgcgtggtggtcgacgtgagccacgaggaccccgaggtgaagttcaacgtctacgtggacggggtggaggtccacaacgcgaagaccaagccccgggaggagcagtacgcctccacctaccgcgtggtgagcgtcctcaccgtgctgcaccaggactggctgaacggcaaggagtacaagtgcaaggtgtccaacaaggccctccccgccccgatcgagaagacgatcagcaaggccaag

SEQ ID NO: 15241 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgccccgagcgtgttcctgttcccgcccaagcccaaggacaccctgatgatctcccgcacccccgaggtcacgtgcgtggtggtcgacgtgagccacgaggaccccgaggtgaagttcaactggtacgtcgacggggtggaggtgcacaacgcgaagaccaagccccgggaggagcagtacaactccacctaccgcgtcgtgagcgtgctcaccgtcctgcaccaggactggctgaacggcaaggagtacaagtgcaaggtgtccaacaaggccctccccgccccgatcgagaagacgatcagcaaggccaag

SEQ ID NO: 15242 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctgctcggcgccccgagcgtgttcctgttcccgcccaagcccaaggacaccctgatgatctcccgcacccccgaggtcacgtgcgtggtggtcgacgtgagccacgaggaccccgaggtgaagttcaactggtacgtcgacggggtggaggtgcacaacgcgaagaccaagccccgggaggagcagtacgcctccacctaccgcgtcgtgagcgtgctcaccgtcctgcaccaggactggctgaacggcaaggagtacaagtgcaaggtgtccaacaaggccctccccgccccgatcgagaagacgatcagcaaggccaag

SEQ ID NO: 15243 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgggccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggcgtggaggtccacaacgcgaagaccaagccccgggaggagcagtacaactccacctaccgcgtggtgagcgtcctgaccgtgctccaccaggactggctgaacgggaaggagtacaagtgcaaggtgtccaacaaggccctgcccgccccgatcgagaagacgatcagcaaggccaag

SEQ ID NO: 15244 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgggccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggcgtggaggtccacaacgcgaagaccaagccccgggaggagcagtacgcctccacctaccgcgtggtgagcgtcctgaccgtgctccaccaggactggctgaacgggaaggagtacaagtgcaaggtgtccaacaaggccctgcccgccccgatcgagaagacgatcagcaaggccaag

SEQ ID NO: 15245 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgggccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggcgtggaggtgcacaacgcgaagaccaagccccgggaggagcagtacaactccacctaccgcgtcgtgagcgtgctgaccgtcctccaccaggactggctgaacgggaaggagtacaagtgcaaggtgtccaacaaggccctgcccgccccgatcgagaagacgatcagcaaggccaag

SEQ ID NO: 15246 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgggccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggcgtggaggtgcacaacgcgaagaccaagccccgggaggagcagtacgcctccacctaccgcgtcgtgagcgtgctgaccgtcctccaccaggactggctgaacgggaaggagtacaagtgcaaggtgtccaacaaggccctgcccgccccgatcgagaagacgatcagcaaggccaag

SEQ ID NO: 15247 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgcgccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggggtggaggtccacaacgccaagaccaagccccgggaggagcagtacaactccacctaccgcgtggtgagcgtcctgaccgtgctccaccaggactggctgaacggcaaggagtacaagtgcaaggtgtccaacaaggccctgcccgccccgatcgagaagacgatcagcaaggccaag

SEQ ID NO: 15248 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgcgccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggggtggaggtccacaacgccaagaccaagccccgggaggagcagtacgcctccacctaccgcgtggtgagcgtcctgaccgtgctccaccaggactggctgaacggcaaggagtacaagtgcaaggtgtccaacaaggccctgcccgccccgatcgagaagacgatcagcaaggcgaag

SEQ ID NO: 15249 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgcgccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggccctgcccgccccgatcgagaagacgatcagcaaggccaag

SEQ ID NO: 15250 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgagctggccggcgcgccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggggtggaggtgcacaacgccaagaccaagccccgggaggagcagtacgcctccacctaccgcgtcgtgagcgtgctgaccgtcctccaccaggactggctgaacggcaaggagtacaagtgcaaggtgtccaacaaggccctgcccgccccgatcgagaagacgatcagcaaggcgaag

SEQ ID NO: 15251 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgggccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggcgtggaggtccacaacgcgaagaccaagccccgggaggagcagtacaactccacctaccgcgtggtgagcgtcctgaccgtgctccaccaggactggctgaacgggaaggagtacaagtgcaaggtgtccaacaaggccctgcccgccccgatcgagaagacgatcagcaaggccaag

SEQ ID NO: 15252 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgggccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggcgtggaggtccacaacgcgaagaccaagccccgggaggagcagtacgcctccacctaccgcgtggtgagcgtcctgaccgtgctccaccaggactggctgaacgggaaggagtacaagtgcaaggtgtccaacaaggccctgcccgccccgatcgagaagacgatcagcaaggccaag

SEQ ID NO: 15253 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgggccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggcgtggaggtgcacaacgcgaagaccaagccccgggaggagcagtacaactccacctaccgcgtcgtgagcgtgctgaccgtcctccaccaggactggctgaacgggaaggagtacaagtgcaaggtgtccaacaaggccctgcccgccccgatcgagaagacgatcagcaaggccaag

SEQ ID NO: 15254 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgggccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggcgtggaggtgcacaacgcgaagaccaagccccgggaggagcagtacgcctccacctaccgcgtcgtgagcgtgctgaccgtcctccaccaggactggctgaacgggaaggagtacaagtgcaaggtgtccaacaaggccctgcccgccccgatcgagaagacgatcagcaaggccaag

SEQ ID NO: 15255 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgcgccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggggtggaggtccacaacgccaagaccaagccccgggaggagcagtacaactccacctaccgcgtggtgagcgtcctgaccgtgctccaccaggactggctgaacggcaaggagtacaagtgcaaggtgtccaacaaggccctgcccgccccgatcgagaagacgatcagcaaggccaag

SEQ ID NO: 15256 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgcgccgagcgtgttcctcttcccgcccaagcccaaggacaccctgatgatctcccgcacccccgaggtcacgtgcgtggtggtcgacgtgagccacgaggaccccgaggtgaagttcaacgtctacgtggacggggtggaggtccacaacgccaagaccaagccccgggaggagcagtacgcctccacctaccgcgtggtgagcgtcctgaccgtgctccaccaggactggctgaacggcaaggagtacaagtgcaaggtgtccaacaaggccctgcccgccccgatcgagaagacgatcagcaaggcgaag

SEQ ID NO: 15257 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgcgccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggccctgcccgccccgatcgagaagacgatcagcaaggccaag

SEQ ID NO: 15258 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccctgggcgcgccgagcgtgttcctcttcccgcccaagcccaaggacaccctgatgatctcccgcacccccgaggtcacgtgcgtggtggtcgacgtgagccacgaggaccccgaggtgaagttcaactggtacgtcgacggggtggaggtgcacaacgccaagaccaagccccgggaggagcagtacgcctccacctaccgcgtcgtgagcgtgctgaccgtcctccaccaggactggctgaacggcaaggagtacaagtgcaaggtgtccaacaaggccctgcccgccccgatcgagaagacgatcagcaaggcgaag

SEQ ID NO: 15259 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgggccgagcgtgttcctgttcccgcccaagcccaaggacaccctcatgatctcccgcacccccgaggtcacgtgcgtggtggtcgacgtgagccacgaggaccccgaggtgaagttcaacgtctacgtggacggcgtggaggtccacaacgccaagaccaagccccgggaggagcagtacaactccacctaccgcgtggtgagcgtcctgaccgtgctgcaccaggactggctcaacgggaaggagtacaagtgcaaggtgtccaacaaggccctgcccgccccgatcgagaagacgatcagcaaggccaag

SEQ ID NO: 15260 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgggccgagcgtgttcctgttcccgcccaagcccaaggacaccctcatgatctcccgcacccccgaggtcacgtgcgtggtggtcgacgtgagccacgaggaccccgaggtgaagttcaacgtctacgtggacggcgtggaggtccacaacgccaagaccaagccccgggaggagcagtacgcctccacctaccgcgtggtgagcgtcctgaccgtgctgcaccaggactggctcaacgggaaggagtacaagtgcaaggtgtccaacaaggccctgcccgccccgatcgagaagacgatcagcaaggcgaag

SEQ ID NO: 15261 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgggccgagcgtgttcctgttcccgcccaagcccaaggacaccctcatgatctcccgcacccccgaggtcacgtgcgtggtggtcgacgtgagccacgaggaccccgaggtgaagttcaactggtacgtcgacggcgtggaggtgcacaacgccaagaccaagccccgggaggagcagtacaactccacctaccgcgtcgtgagcgtgctgaccgtcctgcaccaggactggctcaacgggaaggagtacaagtgcaaggtgtccaacaaggccctgcccgccccgatcgagaagacgatcagcaaggccaag

SEQ ID NO: 15262 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgggccgagcgtgttcctgttcccgcccaagcccaaggacaccctcatgatctcccgcacccccgaggtcacgtgcgtggtggtcgacgtgagccacgaggaccccgaggtgaagttcaactggtacgtcgacggcgtggaggtgcacaacgccaagaccaagccccgggaggagcagtacgcctccacctaccgcgtcgtgagcgtgctgaccgtcctgcaccaggactggctcaacgggaaggagtacaagtgcaaggtgtccaacaaggccctgcccgccccgatcgagaagacgatcagcaaggcgaag

SEQ ID NO: 15263 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgccccgagcgtgttcctgttcccgcccaagcccaaggacaccctcatgatctcccgcacccccgaggtcacgtgcgtggtggtcgacgtgagccacgaggaccccgaggtgaagttcaacgtctacgtggacggggtggaggtccacaacgccaagaccaagccccgggaggagcagtacaactccacctaccgcgtggtgagcgtcctgaccgtgctgcaccaggactggctcaacggcaaggagtacaagtgcaaggtgtccaacaaggccctgcccgccccgatcgagaagacgatcagcaaggcgaag

SEQ ID NO: 15264 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgccccgagcgtgttcctgttcccgcccaagcccaaggacaccctcatgatctcccgcacccccgaggtcacgtgcgtggtggtcgacgtgagccacgaggaccccgaggtgaagttcaacgtctacgtggacggggtggaggtccacaacgccaagaccaagccccgggaggagcagtacgcctccacctaccgcgtggtgagcgtcctgaccgtgctgcaccaggactggctcaacggcaaggagtacaagtgcaaggtgtccaacaaggccctgcccgcgccgatcgagaagacgatcagcaaggccaag

SEQ ID NO: 15265 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgccccgagcgtgttcctgttcccgcccaagcccaaggacaccctcatgatctcccgcacccccgaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctgcaccaggactggctcaacggcaaggagtacaagtgcaaggtgtccaacaaggccctgcccgccccgatcgagaagacgatcagcaaggcgaag

SEQ ID NO: 15266 - RNA, 330 nt, synthetic construct
  misc_feature 1..330: note = derived and/or modified sequence opt1 from IgG1_HeavyChain_CH2_constant_domain
  source 1..330: mol_type = other RNA
gcccccgaggccgcgggcgccccgagcgtgttcctgttcccgcccaagcccaaggacaccctcatgatctcccgcacccccgaggtcacgtgcgtggtggtcgacgtgagccacgaggaccccgaggtgaagttcaactggtacgtcgacggggtggaggtgcacaacgccaagaccaagccccgggaggagcagtacgcctccacctaccgcgtcgtgagcgtgctgaccgtcctgcaccaggactggctcaacggcaaggagtacaagtgcaaggtgtccaacaaggccctgcccgcgccgatcgagaagacgatcagcaaggccaag

SEQ ID NO: 15267 - RNA, 318 nt, synthetic construct
  misc_feature 1..318: note = derived and/or modified sequence opt1 from IgG1_HeavyChain_CH3_constant_domain
  source 1..318: mol_type = other RNA
ggccagccccgcgagccccaggtgtacaccctgccgcccagccgggaggagatgaccaagaaccaggtctccctcacgtgcctggtgaaggggttctaccccagcgacatcgccgtggagtgggagtccaacggccagcccgagaacaactacaagaccaccccgcccgtcctggacagcgacgggtccttcttcctctacagcaagctgaccgtggacaagtcccgctggcagcagggcaacgtgttcagctgctccgtcatgcacgaggccctgcacaaccactacacgcagaagtccctcagcctgagccccggg

SEQ ID NO: 15268 - RNA, 318 nt, synthetic construct
  misc_feature 1..318: note = derived and/or modified sequence opt1 from IgG1_HeavyChain_CH3_constant_domain
  source 1..318: mol_type = other RNA
ggccagccccgcgagccccaggtgtacaccctgccgcccagccgggaggagctcaccaagaaccaggtctccctgacgtgcctggtgaaggggttctaccccagcgacatcgccgtggagtgggagtccaacggccagcccgagaacaactacaagaccaccccgcccgtcctcgacagcgacgggtccttcttcctgtacagcaagctgaccgtggacaagtcccgctggcagcagggcaacgtgttcagctgctccgtcatgcacgaggccctccacaaccactacacgcagaagtccctgagcctgagccccggg

SEQ ID NO: 15269 - RNA, 318 nt, synthetic construct
  misc_feature 1..318: note = derived and/or modified sequence opt1 from IgG1_HeavyChain_CH3_constant_domain
  source 1..318: mol_type = other RNA
ggccagccccgcgagccccaggtgtacaccctgccgcccagccgggacgagatgaccaagaaccaggtctccctcacgtgcctggtgaaggggttctaccccagcgacatcgccgtggagtgggagtccaacggccagcccgagaacaactacaagaccaccccgcccgtcctggacagcgacgggtccttcttcctctacagcaagctgaccgtggacaagtcccgctggcagcagggcaacgtgttcagctgctccgtcatgcacgaggccctgcacaaccactacacgcagaagtccctcagcctgagccccggg

SEQ ID NO: 15270 - RNA, 318 nt, synthetic construct
  misc_feature 1..318: note = derived and/or modified sequence opt1 from IgG1_HeavyChain_CH3_constant_domain
  source 1..318: mol_type = other RNA
ggccagccccgcgagccccaggtgtacaccctgccgcccagccgggacgagctcaccaagaaccaggtctccctgacgtgcctggtgaaggggttctaccccagcgacatcgccgtggagtgggagtccaacggccagcccgagaacaactacaagaccaccccgcccgtcctcgacagcgacgggtccttcttcctgtacagcaagctgaccgtggacaagtcccgctggcagcagggcaacgtgttcagctgctccgtcatgcacgaggccctccacaaccactacacgcagaagtccctgagcctgagccccggg

SEQ ID NO: 15271 - RNA, 297 nt, synthetic construct
  misc_feature 1..297: note = derived and/or modified sequence opt1 from IgG2_HeavyChain_CH1_constant_domain
  source 1..297: mol_type = other RNA
agcgcctccaccaagggccccagcgtgttcccgctggccccctgctcccgcagcacctccgagagcacggcggccctcgggtgcctggtcaaggactacttccccgagcccgtgaccgtgtcctggaacagcggcgccctgacctccggggtccacaccttcccggccgtgctccagagctccggcctgtacagcctgtccagcgtggtcacggtgccctccagcaacttcgggacccagacctacacgtgcaacgtggaccacaagccctccaacaccaaggtcgacaagaccgtg

SEQ ID NO: 15272 - RNA, 297 nt, synthetic construct
  misc_feature 1..297: note = derived and/or modified sequence opt1 from IgG2_HeavyChain_CH1_constant_domain
  source 1..297: mol_type = other RNA
agcgcctccaccaagggccccagcgtgttcccgctggccccctgctcccgcagcacctccgagagcacggcggccctcgggtgcctggtcaaggactacttccccgagcccgtgaccgtgtcctggaacagcggcgccctgacctccggggtccacaccttcccggccgtgctccagagctccggcctgtacagcctgtccagcgtggtcacggtgacctccagcaacttcgggacccagacctacacgtgcaacgtggaccacaagccctccaacaccaaggtcgacaagaccgtg

SEQ ID NO: 15273 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacggggtggaggtccacaacgccaagaccaagccccgggaggagcagttcaactccaccttccgcgtggtgagcgtcctgaccgtggtgcaccaggactggctgaacggcaaggagtacaagtgcaaggtctccaacaaggggctcccggcccccatcgagaagacgatcagcaagaccaag

SEQ ID NO: 15274 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacggggtggaggtccacaacgccaagaccaagccccgggaggagcagttcaactccaccttccgcgtggtgagcgtcctgaccgtggtgcaccaggactggctgaacggcaaggagtacaagtgcaaggtctccaacaaggggctcccggccagcatcgagaagacgatctccaagaccaag

SEQ ID NO: 15275 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacggggtggaggtccacaacgccaagaccaagccccgggaggagcagttcaactccaccttccgcgtggtgagcgtcctgaccgtggtgcaccaggactggctgaacggcaaggagtacaagtgcaaggtctccaacaaggggctcccgagccccatcgagaagacgatctccaagaccaag

SEQ ID NO: 15276 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacggggtggaggtccacaacgccaagaccaagccccgggaggagcagttcaactccaccttccgcgtggtgagcgtcctgaccgtggtgcaccaggactggctgaacggcaaggagtacaagtgcaaggtctccaacaaggggctcccgagctccatcgagaagacgatcagcaagaccaag

SEQ ID NO: 15277 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacgggatggaggtgcacaacgccaagaccaagccccgggaggagcagttcaactccaccttccgcgtcgtgagcgtgctgaccgtcgtgcaccaggactggctgaacggcaaggagtacaagtgcaaggtgtccaacaaggggctcccggcccccatcgagaagacgatcagcaagaccaag

SEQ ID NO: 15278 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacgggatggaggtgcacaacgccaagaccaagccccgggaggagcagttcaactccaccttccgcgtcgtgagcgtgctgaccgtcgtgcaccaggactggctgaacggcaaggagtacaagtgcaaggtgtccaacaaggggctcccggccagcatcgagaagacgatctccaagaccaag

SEQ ID NO: 15279 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacgggatggaggtgcacaacgccaagaccaagccccgggaggagcagttcaactccaccttccgcgtcgtgagcgtgctgaccgtcgtgcaccaggactggctgaacggcaaggagtacaagtgcaaggtgtccaacaaggggctcccgagccccatcgagaagacgatctccaagaccaag

SEQ ID NO: 15280 - RNA, 327 nt, synthetic construct
  misc_feature 1..327: note = derived and/or modified sequence opt1 from IgG2_HeavyChain_CH2_constant_domain
  source 1..327: mol_type = other RNA
gcgcccccggtggccggccccagcgtcttcctgttcccgcccaagcccaaggacaccctcatgatctcccgcacccccgaggtgacgtgcgtggtcgtggacgtgagccacgaggaccccgaggtccagttcaactggtacgtggacgggatggaggtgcacaacgccaagaccaagccccgggaggagcagttcaactccaccttccgcgtcgtgagcgtgctgaccgtcgtgcaccaggactggctgaacggcaaggagtacaagtgcaaggtgtccaacaaggggctcccgagctccatcgagaagacgatcagcaagaccaag

SEQ ID NO: 15281 - RNA, 318 nt, synthetic construct
  misc_feature 1..318: note = derived and/or modified sequence opt1 from IgG2_HeavyChain_CH3_constant_domain
  source 1..318: mol_type = other RNA
ggccagccccgcgagccccaggtgtacaccctgccgcccagccgggaggagatgaccaagaaccaggtctccctcacgtgcctggtgaaggggttctaccccagcgacatcgccgtggagtgggagtccaacggccagcccgagaacaactacaagaccaccccgcccatgctggacagcgacgggtccttcttcctctacagcaagctgaccgtcgacaagtcccgctggcagcagggcaacgtgttcagctgctccgtgatgcacgaggccctgcacaaccactacacgcagaagtccctcagcctgagccccggg

SEQ ID NO: 15282 - RNA, 297 nt, synthetic construct
  misc_feature 1..297: note = derived and/or modified sequence opt1 from IgG4_HeavyChain_CH1_constant_domain
  source 1..297: mol_type = other RNA
agcgcctccaccaagggccccagcgtgttcccgctggccccctgctcccgcagcacctccgagagcacggcggccctcgggtgcctggtcaaggactacttccccgagcccgtgaccgtgtcctggaacagcggcgccctgacctccggggtccacaccttcccggccgtgctccagagctccggcctgtacagcctgtccagcgtggtcacggtgccctccagctccctcgggaccaagacctacacgtgcaacgtggaccacaagcccagcaacaccaaggtcgacaagcgggtg

SEQ ID NO: 15283 - RNA, 330 nt, synthetic construct
  misc_feature 1..330: note = derived and/or modified sequence opt1 from IgG4_HeavyChain_CH2_constant_domain
  source 1..330: mol_type = other RNA
gcccccgagttcctgggcgggccgagcgtgttcctcttcccgcccaagcccaaggacaccctgatgatctcccgcacccccgaggtcacgtgcgtggtggtcgacgtgagccaggaggaccccgaggtgcagttcaactggtacgtcgacggcgtggaggtgcacaacgccaagaccaagccccgggaggagcagttcaactccacctaccgcgtcgtgagcgtgctgaccgtcctccaccaggactggctgaacgggaaggagtacaagtgcaaggtgtccaacaagggcctgcccagctccatcgagaagacgatcagcaaggcgaag

SEQ ID NO: 15284 - RNA, 318 nt, synthetic construct
  misc_feature 1..318: note = derived and/or modified sequence opt1 from IgG4_HeavyChain_CH3_constant_domain
  source 1..318: mol_type = other RNA
ggccagccccgcgagccccaggtgtacaccctgccgcccagccaggaggagatgaccaagaaccaggtctccctcacgtgcctggtgaaggggttctaccccagcgacatcgccgtggagtgggagtccaacggccagcccgagaacaactacaagaccaccccgcccgtcctggacagcgacgggtccttcttcctctacagccggctgaccgtggacaagtcccgctggcaggagggcaacgtgttcagctgctccgtcatgcacgaggccctgcacaaccactacacgcagaagtccctcagcctgagcctgggg

SEQ ID NO: 15285 - RNA, 1347 nt, synthetic construct
  misc_feature 1..1347: note = derived and/or modified sequence opt2 from AAB-003_gamma1-Chain
  source 1..1347: mol_type = other RNA
gaggtccagctcctcgagtccggcggcggcctcgtccagcccggcggctccctccgcctctcctgcgccgcctccggcttcaccttctccaactacggcatgtcctgggtccgccaggcccccggcaagggcctcgagtgggtcgcctccatccgctccggcggcggccgcacctactactccgacaacgtcaagggccgcttcaccatctcccgcgacaactccaagaacaccctctacctccagatgaactccctccgcgccgaggacaccgccgtctactactgcgtccgctacgaccactactccggctcctccgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15286 - RNA, 1329 nt, synthetic construct
  misc_feature 1..1329: note = derived and/or modified sequence opt2 from Abagovomab_HeavyChain
  source 1..1329: mol_type = other RNA
caggtcaagctccaggagtccggcgccgagctcgcccgccccggcgcctccgtcaagctctcctgcaaggcctccggctacaccttcaccaactactggatgcagtgggtcaagcagcgccccggccagggcctcgactggatcggcgccatctaccccggcgacggcaacacccgctacacccacaagttcaagggcaaggccaccctcaccgccgacaagtcctcctccaccgcctacatgcagctctcctccctcgcctccgaggactccggcgtctactactgcgcccgcggcgagggcaactacgcctggttcgcctactggggccagggcaccaccgtcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctggttcgtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatggacaccgacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 15287 - RNA, 642 nt, synthetic construct
  misc_feature 1..642: note = derived and/or modified sequence opt2 from Abagovomab_LightChain
  source 1..642: mol_type = other RNA
gacatcgagctcacccagtcccccgcctccctctccgcctccgtcggcgagaccgtcaccatcacctgccaggcctccgagaacatctactcctacctcgcctggcaccagcagaagcagggcaagtccccccagctcctcgtctacaacgccaagaccctcgccggcggcgtctcctcccgcttctccggctccggctccggcacccacttctccctcaagatcaagtccctccagcccgaggacttcggcatctactactgccagcaccactacggcatcctccccaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15288 - RNA, 1350 nt, synthetic construct
  misc_feature 1..1350: note = derived and/or modified sequence opt2 from Abciximab_HeavyChain
  source 1..1350: mol_type = other RNA
gaggtccagctccagcagtccggcgccgagctcgtcaagcccggcgcctccgtcaagctctcctgcaccgcctccggcttcaacatcaaggacacctacgtccactgggtcaagcagcgccccgagcagggcctcgagtggatcggccgcatcgaccccgccaacggctacaccaagtacgaccccaagttccagggcaaggccaccatcaccgccgacacctcctccaacaccgcctacctccagctctcctccctcacctccgaggacaccgccgtctactactgcgtccgccccctctacgactactacgccatggactactggggccagggcacctccgtcaccgtctcctccgccaagaccaccgccccctccgtctaccccctcgcccccgtctgcggcgacaccaccggctcctccgtcaccctcggctgcctcgtcaagggctacttccccgagcccgtcaccctcacctggaactccggctccctctcctccggcgtccacaccttccccgccgtcctccagtccgacctctacaccctctcctcctccgtcaccgtcacctcctccacctggccctcccagtccatcacctgcaacgtcgcccaccccgcctcctccaccaaggtcgacaagaagatcgagccccgccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15289 - RNA, 642 nt, synthetic construct
  misc_feature 1..642: note = derived and/or modified sequence opt2 from Abciximab_LightChain
  source 1..642: mol_type = other RNA
gacatcctcatgacccagtccccctcctccatgtccgtctccctcggcgacaccgtctccatcacctgccacgcctcccagggcatctcctccaacatcggctggctccagcagaagcccggcaagtccttcatgggcctcatctactacggcaccaacctcgtcgacggcgtcccctcccgcttctccggctccggctccggcgccgactactccctcaccatctcctccctcgactccgaggacttcgccgactactactgcgtccagtacgcccagctcccctacaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15290 - RNA, 1341 nt, synthetic construct
  misc_feature 1..1341: note = derived and/or modified sequence opt2 from Abituzumab_HeavyChain1
  source 1..1341: mol_type = other RNA
caggtccagctccagcagtccggcggcgagctcgccaagcccggcgcctccgtcaaggtctcctgcaaggcctccggctacaccttctcctccttctggatgcactgggtccgccaggcccccggccagggcctcgagtggatcggctacatcaacccccgctccggctacaccgagtacaacgagatcttccgcgacaaggccaccatgaccaccgacacctccacctccaccgcctacatggagctctcctccctccgctccgaggacaccgccgtctactactgcgcctccttcctcggccgcggcgccatggactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcccaagtcctccgacaagacccacacctgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcaggcccagtccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15291 - RNA, 642 nt, synthetic construct
  misc_feature 1..642: note = derived and/or modified sequence opt2 from Abituzumab_LightChain1
  source 1..642: mol_type = other RNA
gacatccagatgacccagtccccctcctccctctccgcctccgtcggcgaccgcgtcaccatcacctgccgcgcctcccaggacatctccaactacctcgcctggtaccagcagaagcccggcaaggcccccaagctcctcatctactacacctccaagatccactccggcgtcccctcccgcttctccggctccggctccggcaccgactacaccttcaccatctcctccctccagcccgaggacatcgccacctactactgccagcagggcaacaccttcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15292 - RNA, 1332 nt, synthetic construct
  misc_feature 1..1332: note = derived and/or modified sequence opt2 from Abrilumab_HeavyChain1
  source 1..1332: mol_type = other RNA
caggtccagctcgtccagtccggcgccgaggtcaagaagcccggcgcctccgtcaaggtctcctgcaaggtctccggctacaccctctccgacctctccatccactgggtccgccaggcccccggcaagggcctcgagtggatgggcggcttcgacccccaggacggcgagaccatctacgcccagaagttccagggccgcgtcaccatgaccgaggacacctccaccgacaccgcctacatggagctctcctccctcaagtccgaggacaccgccgtctactactgcgccaccggctcctcctcctcctggttcgacccctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15293 - RNA, 642 nt, synthetic construct
  misc_feature 1..642: note = derived and/or modified sequence opt2 from Abrilumab_LightChain1
  source 1..642: mol_type = other RNA
gacatccagatgacccagtccccctcctccgtctccgcctccgtcggcgaccgcgtcaccatcacctgccgcgcctcccagggcatctcctcctggctcgcctggtaccagcagaagcccggcaaggcccccaagctcctcatctacggcgcctccaacctcgagtccggcgtcccctcccgcttctccggctccggctccggcaccgacttcaccctcaccatctcctccctccagcccgaggacttcgccaactactactgccagcaggccaactccttcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15294 - RNA, 639 nt, synthetic construct
  misc_feature 1..639: note = derived and/or modified sequence opt2 from Abrilumab_LightChain1_variant2
  source 1..639: mol_type = other RNA
cagatcgtcctcacccagtcccccgccatcatgtccgcctcccccggcgagaaggtcaccatcacctgctccgcctcctcctccgtctcctacatgaactggttccagcagaagcccggcacctcccccaagctctggatctactccacctccaacctcgcctccggcgtccccgcccgcttctccggctccggctccggcacctcctactccctcaccatctcccgcatggaggccgaggacgccgccacctactactgccagcagcgctcctcctaccccaacaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15295 - RNA, 1347 nt, synthetic construct
  misc_feature 1..1347: note = derived and/or modified sequence opt2 from Actoxumab_HeavyChain1
  source 1..1347: mol_type = other RNA
gaggtccagctcgtccagtccggcgccgaggtcaagaagtccggcgagtccctcaagatctcctgcaagggctccggctactccttcacctcctactggatcggctgggtccgccagatgcccggcaagggcctcgagtggatgggcatcttctaccccggcgactcctccacccgctactccccctccttccagggccaggtcaccatctccgccgacaagtccgtcaacaccgcctacctccagtggtcctccctcaaggcctccgacaccgccatgtactactgcgcccgccgccgcaactggggcaacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15296 - RNA, 645 nt, synthetic construct
  misc_feature 1..645: note = derived and/or modified sequence opt2 from Actoxumab_LightChain1
  source 1..645: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccacctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15297 - RNA, 672 nt, synthetic construct
  misc_feature 1..672: note = derived and/or modified sequence opt2 from Adalimumab_HeavyChain
  source 1..672: mol_type = other RNA
gaggtccagctcgtcgagtccggcggcggcctcgtccagcccggccgctccctccgcctctcctgcgccgcctccggcttcaccttcgacgactacgccatgcactgggtccgccaggcccccggcaagggcctcgagtgggtctccgccatcacctggaactccggccacatcgactacgccgactccgtcgagggccgcttcaccatctcccgcgacaacgccaagaactccctctacctccagatgaactccctccgcgccgaggacaccgccgtctactactgcgccaaggtctcctacctctccaccgcctcctccctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 15298 - RNA, 642 nt, synthetic construct
  misc_feature 1..642: note = derived and/or modified sequence opt2 from Adalimumab_LightChain
  source 1..642: mol_type = other RNA
gacatccagatgacccagtccccctcctccctctccgcctccgtcggcgaccgcgtcaccatcacctgccgcgcctcccagggcatccgcaactacctcgcctggtaccagcagaagcccggcaaggcccccaagctcctcatctacgccgcctccaccctccagtccggcgtcccctcccgcttctccggctccggctccggcaccgacttcaccctcaccatctcctccctccagcccgaggacgtcgccacctactactgccagcgctacaaccgcgccccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15299 - RNA, 1359 nt, synthetic construct
  misc_feature 1..1359: note = derived and/or modified sequence opt2 from Aducanumab_HeavyChain1
  source 1..1359: mol_type = other RNA
caggtccagctcgtcgagtccggcggcggcgtcgtccagcccggccgctccctccgcctctcctgcgccgcctccggcttcgccttctcctcctacggcatgcactgggtccgccaggcccccggcaagggcctcgagtgggtcgccgtcatctggttcgacggcaccaagaagtactacaccgactccgtcaagggccgcttcaccatctcccgcgacaactccaagaacaccctctacctccagatgaacaccctccgcgccgaggacaccgccgtctactactgcgcccgcgaccgcggcatcggcgcccgccgcggcccctactacatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15300 - RNA, 642 nt, synthetic construct
  misc_feature 1..642: note = derived and/or modified sequence opt2 from Aducanumab_LightChain1
  source 1..642: mol_type = other RNA
gacatccagatgacccagtccccctcctccctctccgcctccgtcggcgaccgcgtcaccatcacctgccgcgcctcccagtccatctcctcctacctcaactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagtcctactccacccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15301 - RNA, 1359 nt, synthetic construct
  misc_feature 1..1359: note = derived and/or modified sequence opt2 from Afasevikumab_HeavyChain1
  source 1..1359: mol_type = other RNA
gaggtccagctcgtcgagtccggcggcggcctcgtccagcccggccgctccctccgcctctcctgcgccgcctccggcttcaccttcgacgactacgccatgcactgggtccgccaggcccccggcaagggcctcgagtgggtctccggcatcaactggtcctccggcggcatcggctacgccgactccgtcaagggccgcttcaccatctcccgcgacaacgccaagaactccctctacctccagatgaactccctccgcgccgaggacaccgccctctactactgcgcccgcgacatcggcggcttcggcgagttctactggaacttcggcctctggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15302 - RNA, 645 nt, synthetic construct
  misc_feature 1..645: note = derived and/or modified sequence opt2 from Afasevikumab_LightChain1
  source 1..645: mol_type = other RNA
gagatcgtcctcacccagtcccccgccaccctctccctctcccccggcgagcgcgccaccctctcctgccgcgcctcccagtccgtccgctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccgccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15303 - RNA, 1293 nt, synthetic construct
  misc_feature 1..1293: note = derived and/or modified sequence opt2 from Aflibercept_Fusion_protein1
  source 1..1293: mol_type = other RNA
tccgacaccggccgccccttcgtcgagatgtactccgagatccccgagatcatccacatgaccgagggccgcgagctcgtcatcccctgccgcgtcacctcccccaacatcaccgtcaccctcaagaagttccccctcgacaccctcatccccgacggcaagcgcatcatctgggactcccgcaagggcttcatcatctccaacgccacctacaaggagatcggcctcctcacctgcgaggccaccgtcaacggccacctctacaagaccaactacctcacccaccgccagaccaacaccatcatcgacgtcgtcctctccccctcccacggcatcgagctctccgtcggcgagaagctcgtcctcaactgcaccgcccgcaccgagctcaacgtcggcatcgacttcaactgggagtacccctcctccaagcaccagcacaagaagctcgtcaaccgcgacctcaagacccagtccggctccgagatgaagaagttcctctccaccctcaccatcgacggcgtcacccgctccgaccagggcctctacacctgcgccgcctcctccggcctcatgaccaagaagaactccaccttcgtccgcgtccacgagaaggacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15304 - RNA, 1332 nt, synthetic construct
  misc_feature 1..1332: note = derived and/or modified sequence opt2 from Afutuzuab_HeavyChain1
  source 1..1332: mol_type = other RNA
caggtccagctcgtccagtccggcgccgaggtcaagaagcccggctcctccgtcaaggtctcctgcaaggcctccggctacgccttctcctactcctggatcaactgggtccgccaggcccccggccagggcctcgagtggggccgcatcttccccggcgacggcgacaccgactacaacggcaagttcaagggccgcgtcaccatcaccgccgacaagtccacctccaccgcctacgagctctcctccctccgctccgaggacaccgccgtctactactgcgcccgcaacgtcttcgacggctactggctcgtctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 15305 - RNA, 651 nt, synthetic construct
  misc_feature 1..651: note = derived and/or modified sequence opt2 from Afutuzuab_LightChain1
  source 1..651: mol_type = other RNA
gacatcgtcacccagacccccctctccctccccgtcacccccggcgagcccgcctccatctcctgccgctcctccaagtccctcctccactccaacggcatcacctacctctactggtacctccagaagcccggccagtccccccagctcctcatctaccagtccaacctcgtctccggcgtccccgaccgcttctccggctccggctccggcaccgacttcaccctcaagatctcccgcgtcgaggccgaggacgtcggcgtctactactgcgcccagaacctcgagctcccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15306 - RNA, 1347 nt, synthetic construct
  misc_feature 1..1347: note = derived and/or modified sequence opt2 from Afutuzumab_HeavyChain1
  source 1..1347: mol_type = other RNA
caggtccagctcgtccagtccggcgccgaggtcaagaagcccggctcctccgtcaaggtctcctgcaaggcctccggctacgccttctcctactcctggatcaactgggtccgccaggcccccggccagggcctcgagtggatgggccgcatcttccccggcgacggcgacaccgactacaacggcaagttcaagggccgcgtcaccatcaccgccgacaagtccacctccaccgcctacatggagctctcctccctccgctccgaggacaccgccgtctactactgcgcccgcaacgtcttcgacggctactggctcgtctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15307 - RNA, 657 nt, synthetic construct
  misc_feature 1..657: note = derived and/or modified sequence opt2 from Afutuzumab_LightChain1
  source 1..657: mol_type = other RNA
gacatcgtcatgacccagacccccctctccctccccgtcacccccggcgagcccgcctccatctcctgccgctcctccaagtccctcctccactccaacggcatcacctacctctactggtacctccagaagcccggccagtccccccagctcctcatctaccagatgtccaacctcgtctccggcgtccccgaccgcttctccggctccggctccggcaccgacttcaccctcaagatctcccgcgtcgaggccgaggacgtcggcgtctactactgcgcccagaacctcgagctcccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15308 - RNA, 684 nt, synthetic construct
  misc_feature 1..684: note = derived and/or modified sequence opt2 from Alacizumab_pegol_HeavyChain1
  source 1..684: mol_type = other RNA
gaggtccagctcgtcgagtccggcggcggcctcgtccagcccggcggctccctccgcctctcctgcgccgcctccggcttcaccttctcctcctacggcatgtcctgggtccgccaggcccccggcaagggcctcgagtgggtcgccaccatcacctccggcggctcctacacctactacgtcgactccgtcaagggccgcttcaccatctcccgcgacaacgccaagaacaccctctacctccagatgaactccctccgcgccgaggacaccgccgtctactactgcgtccgcatcggcgaggacgccctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgcgccgcc

SEQ ID NO: 15309 - RNA, 642 nt, synthetic construct
  misc_feature 1..642: note = derived and/or modified sequence opt2 from Alacizumab_pegol_LightChain1
  source 1..642: mol_type = other RNA
gacatccagatgacccagtccccctcctccctctccgcctccgtcggcgaccgcgtcaccatcacctgccgcgcctcccaggacatcgccggctccctcaactggctccagcagaagcccggcaaggccatcaagcgcctcatctacgccacctcctccctcgactccggcgtccccaagcgcttctccggctcccgctccggctccgactacaccctcaccatctcctccctccagcccgaggacttcgccacctactactgcctccagtacggctccttcccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15310 - RNA, 1353 nt, synthetic construct
  misc_feature 1..1353: note = derived and/or modified sequence opt2 from Alemtuzumab_HeavyChain
  source 1..1353: mol_type = other RNA
caggtccagctccaggagtccggccccggcctcgtccgcccctcccagaccctctccctcacctgcaccgtctccggcttcaccttcaccgacttctacatgaactgggtccgccagccccccggccgcggcctcgagtggatcggcttcatccgcgacaaggccaagggctacaccaccgagtacaacccctccgtcaagggccgcgtcaccatgctcgtcgacacctccaagaaccagttctccctccgcctctcctccgtcaccgccgccgacaccgccgtctactactgcgcccgcgagggccacaccgccgcccccttcgactactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15311 - RNA, 657 nt, synthetic construct
  misc_feature 1..657: note = derived and/or modified sequence opt2 from Alemtuzumab_HeavyChain_variant_1bey_H
  source 1..657: mol_type = other RNA
caggtccagctccaggagtccggccccggcctcgtccgcccctcccagaccctctccctcacctgcaccgtctccggcttcaccttcaccgacttctacatgaactgggtccgccagccccccggccgcggcctcgagtggatcggcttcatccgcgacaaggccaagggctacaccaccgagtacaacccctccgtcaagggccgcgtcaccatgctcgtcgacacctccaagaaccagttctccctccgcctctcctccgtcaccgccgccgacaccgccgtctactactgcgcccgcgagggccacaccgccgcccccttcgactactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtc

SEQ ID NO: 15312 - RNA, 660 nt, synthetic construct
  misc_feature 1..660: note = derived and/or modified sequence opt2 from Alemtuzumab_HeavyChain_variant_1ce1_H
  source 1..660: mol_type = other RNA
caggtccagctccaggagtccggccccggcctcgtccgcccctcccagaccctctccctcacctgcaccgtctccggcttcaccttcaccgacttctacatgaactgggtccgccagccccccggccgcggcctcgagtggatcggcttcatccgcgacaaggccaagggctacaccaccgagtacaacccctccgtcaagggccgcgtcaccatgctcgtcgacacctccaagaaccagttctccctccgcctctcctccgtcaccgccgccgacaccgccgtctactactgcgcccgcgagggccacaccgccgcccccttcgactactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgag

SEQ ID NO: 15313 - RNA, 1311 nt, synthetic construct
  misc_feature 1..1311: note = derived and/or modified sequence opt2 from Alemtuzumab_HeavyChain_variant_8005_H
  source 1..1311: mol_type = other RNA
caggtccagctccaggagtccggccccggcctcgtccgcccctcccagaccctctccctcacctgcaccgtctccggcttcaccttcaccgacttctacatgaactgggtccgccagccccccggccgcggcctcgagtggatcggcttcatccgcgacaaggccaagggctacaccaccgagtacaacccctccgtcaagggccgcgtcaccatgctcgtcgacacctccaagaaccagttctccctccgcctctcctccgtcaccgccgccgacaccgccgtctactactgcgcccgcgagggccacaccgccgcccccttcgactactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgaggcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15314 - RNA, 633 nt, synthetic construct
  misc_feature 1..633: note = derived and/or modified sequence opt2 from Alemtuzumab_LightChain
  source 1..633: mol_type = other RNA
gacatccagatgacccagtccccctcctccctctccgcctccgtcggcgaccgcgtcaccatcacctgcaaggcctcccagaacatcgacaagtacctcaactggtaccagcagaagcccggcaaggcccccaagctcctcatctacaacaccaacaacctccagaccggcgtcccctcccgcttctccggctccggctccggcaccgacttcaccttcaccatctcctccctccagcccgaggacatcgccacctactactgcctccagcacatctcccgcccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 15315 - RNA, 642 nt, synthetic construct
  misc_feature 1..642: note = derived and/or modified sequence opt2 from Alemtuzumab_LightChain_variant_8005_L
  source 1..642: mol_type = other RNA
gacatccagatgacccagtccccctcctccctctccgcctccgtcggcgaccgcgtcaccatcacctgcaaggcctcccagaacatcgacaagtacctcaactggtaccagcagaagcccggcaaggcccccaagctcctcatctacaacaccaacaacctccagaccggcgtcccctcccgcttctccggctccggctccggcaccgacttcaccttcaccatctcctccctccagcccgaggacatcgccacctactactgcctccagcacatctcccgcccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15316 - RNA, 1341 nt, synthetic construct
  misc_feature 1..1341: note = derived and/or modified sequence opt2 from Alirocumab_HeavyChain1
  source 1..1341: mol_type = other RNA
gaggtccagctcgtcgagtccggcggcggcctcgtccagcccggcggctccctccgcctctcctgcgccgcctccggcttcaccttcaacaactacgccatgaactgggtccgccaggcccccggcaagggcctcgactgggtctccaccatctccggctccggcggcaccaccaactacgccgactccgtcaagggccgcttcatcatctcccgcgactcctccaagcacaccctctacctccagatgaactccctccgcgccgaggacaccgccgtctactactgcgccaaggactccaactggggcaacttcgacctctggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15317 - RNA, 660 nt, synthetic construct
  misc_feature 1..660: note = derived and/or modified sequence opt2 from Alirocumab_LightChain1
  source 1..660: mol_type = other RNA
gacatcgtcatgacccagtcccccgactccctcgccgtctccctcggcgagcgcgccaccatcaactgcaagtcctcccagtccgtcctctaccgctccaacaaccgcaacttcctcggctggtaccagcagaagcccggccagccccccaacctcctcatctactgggcctccacccgcgagtccggcgtccccgaccgcttctccggctccggctccggcaccgacttcaccctcaccatctcctccctccaggccgaggacgtcgccgtctactactgccagcagtactacaccaccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15318 - RNA, 735 nt, synthetic construct
  misc_feature 1..735: note = derived and/or modified sequence opt2 from ALX-0061_HeavyChain1
  source 1..735: mol_type = other RNA
gaggtccagctcgtcgagtccggcggcggcctcgtccagcccggcggctccctccgcctctcctgcgccgcctccggctccgtcttcaagatcaacgtcatggcctggtaccgccaggcccccggcaagggccgcgagctcgtcgccggcatcatctccggcggctccacctcctacgccgactccgtcaagggccgcttcaccatctcccgcgacaacgccaagaacaccctctacctccagatgaactccctccgccccgaggacaccgccgtctactactgcgccttcatcaccaccgagtccgactacgacctcggccgccgctactggggccagggcaccctcgtcaccgtctcctccggcggcggcggctccggcggcggctccgaggtccagctcgtcgagtccggcggcggcctcgtccagcccggcaactccctccgcctctcctgcgccgcctccggcttcaccttctcctccttcggcatgtcctgggtccgccaggcccccggcaagggcctcgagtgggtctcctccatctccggctccggctccgacaccctctacgccgactccgtcaagggccgcttcaccatctcccgcgacaacgccaagaccaccctctacctccagatgaactccctccgccccgaggacaccgccgtctactactgcaccatcggcggctccctctcccgctcctcccagggcaccctcgtcaccgtctcctcc

SEQ ID NO: 15319 - RNA, 1347 nt, synthetic construct
  misc_feature 1..1347: note = derived and/or modified sequence opt2 from Amatuximab_HeavyChain1
  source 1..1347: mol_type = other RNA
caggtccagctccagcagtccggccccgagctcgagaagcccggcgcctccgtcaagatctcctgcaaggcctccggctactccttcaccggctacaccatgaactgggtcaagcagtcccacggcaagtccctcgagtggatcggcctcatcaccccctacaacggcgcctcctcctacaaccagaagttccgcggcaaggccaccctcaccgtcgacaagtcctcctccaccgcctacatggacctcctctccctcacctccgaggactccgccgtctacttctgcgcccgcggcggctacgacggccgcggcttcgactactggggctccggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15320 - RNA, 639 nt, synthetic construct
  misc_feature 1..639: note = derived and/or modified sequence opt2 from Amatuximab_LightChain1
  source 1..639: mol_type = other RNA
gacatcgagctcacccagtcccccgccatcatgtccgcctcccccggcgagaaggtcaccatgacctgctccgcctcctcctccgtctcctacatgcactggtaccagcagaagtccggcacctcccccaagcgctggatctacgacacctccaagctcgcctccggcgtccccggccgcttctccggctccggctccggcaactcctactccctcaccatctcctccgtcgaggccgaggacgacgccacctactactgccagcagtggtccaagcaccccctcaccttcggctccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15321 - RNA, 1350 nt, synthetic construct
  misc_feature 1..1350: note = derived and/or modified sequence opt2 from Anetumab_ravtansine_HeavyChain1
  source 1..1350: mol_type = other RNA
caggtcgagctcgtccagtccggcgccgaggtcaagaagcccggcgagtccctcaagatctcctgcaagggctccggctactccttcacctcctactggatcggctgggtccgccaggcccccggcaagggcctcgagtggatgggcatcatcgaccccggcgactcccgcacccgctactccccctccttccagggccaggtcaccatctccgccgacaagtccatctccaccgcctacctccagtggtcctccctcaaggcctccgacaccgccatgtactactgcgcccgcggccagctctacggcggcacctacatggacggctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15322 - RNA, 651 nt, synthetic construct
  misc_feature 1..651: note = derived and/or modified sequence opt2 from Anetumab_ravtansine_LightChain1
  source 1..651: mol_type = other RNA
gacatcgccctcacccagcccgcctccgtctccggctcccccggccagtccatcaccatctcctgcaccggcacctcctccgacatcggcggctacaactccgtctcctggtaccagcagcaccccggcaaggcccccaagctcatgatctacggcgtcaacaaccgcccctccggcgtctccaaccgcttctccggctccaagtccggcaacaccgcctccctcaccatctccggcctccaggccgaggacgaggccgactactactgctcctcctacgacatcgagtccgccacccccgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaagggcgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15323 - RNA, 1341 nt, synthetic construct
  misc_feature 1..1341: note = derived and/or modified sequence opt2 from Anifrolumab_HeavyChain1
  source 1..1341: mol_type = other RNA
gaggtccagctcgtccagtccggcgccgaggtcaagaagcccggcgagtccctcaagatctcctgcaagggctccggctacatcttcaccaactactggatcgcctgggtccgccagatgcccggcaagggcctcgagtccatgggcatcatctaccccggcgactccgacatccgctactccccctccttccagggccaggtcaccatctccgccgacaagtccatcaccaccgcctacctccagtggtcctccctcaaggcctccgacaccgccatgtactactgcgcccgccacgacatcgagggcttcgactactggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagttcgagggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcctccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15324 - RNA, 645 nt, synthetic construct
  misc_feature 1..645: note = derived and/or modified sequence opt2 from Anifrolumab_LightChain1
  source 1..645: mol_type = other RNA
gagatcgtcctcacccagtcccccggcaccctctccctctcccccggcgagcgcgccaccctctcctgccgcgcctcccagtccgtctcctcctccttcttcgcctggtaccagcagaagcccggccaggccccccgcctcctcatctacggcgcctcctcccgcgccaccggcatccccgaccgcctctccggctccggctccggcaccgacttcaccctcaccatcacccgcctcgagcccgaggacttcgccgtctactactgccagcagtacgactcctccgccatcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15325 - RNA, 1344 nt, synthetic construct
  misc_feature 1..1344: note = derived and/or modified sequence opt2 from Anrukinzumab_HeavyChain1
  source 1..1344: mol_type = other RNA
gaggtccagctcgtcgagtccggcggcggcctcgtccagcccggcggctccctccgcctctcctgcgccgcctccggcttcaccttcatctcctacgccatgtcctgggtccgccaggcccccggcaagggcctcgagtgggtcgcctccatctcctccggcggcaacacctactaccccgactccgtcaagggccgcttcaccatctcccgcgacaacgccaagaactccctctacctccagatgaactccctccgcgccgaggacaccgccgtctactactgcgcccgcctcgacggctactacttcggcttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccctcggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15326 - RNA, 654 nt, synthetic construct
  misc_feature 1..654: note = derived and/or modified sequence opt2 from Anrukinzumab_LightChain1
  source 1..654: mol_type = other RNA
gacatccagatgacccagtccccctcctccctctccgcctccgtcggcgaccgcgtcaccatcacctgcaaggcctccgagtccgtcgacaactacggcaagtccctcatgcactggtaccagcagaagcccggcaaggcccccaagctcctcatctaccgcgcctccaacctcgagtccggcgtcccctcccgcttctccggctccggctccggcaccgacttcaccctcaccatctcctccctccagcccgaggacttcgccacctactactgccagcagtccaacgaggacccctggaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15327 - RNA, 1338 nt, synthetic construct
  misc_feature 1..1338: note = derived and/or modified sequence opt2 from Apolizumab_HeavyChain1
  source 1..1338: mol_type = other RNA
caggtccagctccaggagtccggccccggcctcgtcaagccctccgagaccctctccctcacctgcaccgtctccggcttctccctcaccaactacggcgtccactgggtccgccagtcccccggcaagggcctcgagtggatcggcgtcaagtggtccggcggctccaccgagtacaacgccgccttcatctcccgcctcaccatctccaaggacacctccaagaaccaggtctccctcaagctcaactccctcaccgccgccgacaccgccgtctactactgcgcccgcaacgaccgctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15328 - RNA, 642 nt, synthetic construct
  misc_feature 1..642: note = derived and/or modified sequence opt2 from Apolizumab_LightChain1
  source 1..642: mol_type = other RNA
gacatccagatgacccagtccccctcctccctctccgcctccgtcggcgaccgcgtcaccatcacctgccgcgcctccgagaacatctactcctacctcgcctggtaccagcagaagcccggcaaggcccccaagctcctcgtctccaacgccaagaccctcgccgagggcgtcccctcccgcttctccggctccggctccggcaagcagttcaccctcaccatctcctccctccagcccgaggacttcgccacctactactgccagcaccactacggcaactcctaccccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15329 - RNA, 378 nt, synthetic construct
  misc_feature 1..378: note = derived and/or modified sequence opt2 from Apomab_HeavyChain
  source 1..378: mol_type = other RNA
gaggtccagctcgtccagtccggcggcggcgtcgagcgccccggcggctccctccgcctctcctgcgccgcctccggcttcaccttcgacgactacgccatgtgggtccgccaggcccccggcaagggcctcgagtgggtctccggcatcaactggcagggcggctccaccggctacgccgactccgtcaagggccgcgtcaccatctcccgcgacaacgccaagaactccctctacctccagatgaactccctccgcgccgaggacaccgccgtctactactgcgccaagatcctcggcgccggccgcggctggtacttcgactactggggcaagggcaccaccgtcaccgtctcctccgcctccaccaagggcccc

SEQ ID NO: 15330 - RNA, 324 nt, synthetic construct
  misc_feature 1..324: note = derived and/or modified sequence opt2 from Apomab_LightChain
  source 1..324: mol_type = other RNA
tccgagctcacccaggaccccgccgtctccgtcgccctcggccagaccgtccgcatcacctgctccggcgactccctccgctcctactacgcctcctggtaccagcagaagcccggccaggcccccgtcctcgtcatctacggcgccaacaaccgcccctccggcatccccgaccgcttctccggctcctcctccggcaacaccgcctccctcaccatcaccggcgcccaggccgaggacgaggccgactactactgcaactccgccgactcctccggcaaccacgtcgtcttcggcggcggcaccaagctcaccgtcctcggc

SEQ ID NO: 15331 - RNA, 645 nt, synthetic construct
  misc_feature 1..645: note = derived and/or modified sequence opt2 from Aquaporumab_LightChain
  source 1..645: mol_type = other RNA
gagatcgtcctcacccagtcccccggcaccctctccctctcccccggcgagcgcgccaccctctcctgccgcgcctcccagaccgtccgcaccaactacctcgcctggttccagcagaagcccggccaggccccccgcctcctcatcttcggcgcctcctcccgcgccaccggcatccccgaccgcttctccggctccggctccggcaccgacttcaccctcaccatctcccgcctcgagcccgaggacttcgccgtctactactgccagcagtacggctcctccccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15332 - RNA, 1326 nt, synthetic construct
  misc_feature 1..1326: note = derived and/or modified sequence opt2 from Arcitumomab_99tc_HeavyChain
  source 1..1326: mol_type = other RNA
gaggtcaagctcgtcgagtccggcggcggcctcgtccagcccggcggctccctccgcctctcctgcgccacctccggcttcaccttcaccgactactacatgaactgggtccgccagccccccggcaaggccctcgagtggctcggcttcatcggcaacaaggccaacggctacaccaccgagtactccgcctccgtcaagggccgcttcaccatctcccgcgacaagtcccagtccatcctctacctccagatgaacaccctccgcgccgaggactccgccacctactactgcacccgcgaccgcggcctccgcttctacttcgactactggggccagggcaccaccctcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccccccgcccctccgagaccgtcacctgcaacgtcgcccaccccgcctcctccaccaaggtcgacaagaagatcgtcccccgcgactgccccccctgcaagtgccccgcccccaacctcctcggcggcccctccgtcttcatcttcccccccaagatcaaggacgtcctcatgatctccctctcccccatcgtcacctgcgtcgtcgtcgacgtctccgaggacgaccccgacgtccagatctcctggttcgtcaacaacgtcgaggtccacaccgcccagacccagacccaccgcgaggactacaactccaccctccgcgtcgtctccgccctccccatccagcaccaggactggatgtccggcaaggagttcaagtgcaaggtcaacaacaaggacctccccgcccccatcgagcgcaccatctccaagcccaagggctccgtccgcgccccccaggtctacgtcctccccccccccgaggaggagatgaccaagaagcaggtcaccctcacctgcatggtcaccgacttcatgcccgaggacatctacgtcgagtggaccaacaacggcaagaccgagctcaactacaagaacaccgagcccgtcctcgactccgacggctcctacttcatgtactccaagctccgcgtcgagaagaagaactgggtcgagcgcaactcctactcctgctccgtcgtccacgagggcctccacaaccaccacaccaccaagtccttctcccgc

SEQ ID NO: 15333 - RNA, 639 nt, synthetic construct
  misc_feature 1..639: note = derived and/or modified sequence opt2 from Arcitumomab_99tc_LightChain
  source 1..639: mol_type = other RNA
cagaccgtcctctcccagtcccccgccatcctctccgcctcccccggcgagaaggtcaccatgacctgccgcgcctcctcctccgtcacctacatccactggtaccagcagaagcccggctcctcccccaagtcctggatctacgccacctccaacctcgcctccggcgtccccgcccgcttctccggctccggctccggcacctcctactccctcaccatctcccgcgtcgaggccgaggacgccgccacctactactgccagcactggtcctccaagccccccaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15334 - RNA, 1329 nt, synthetic construct
  misc_feature 1..1329: note = derived and/or modified sequence opt2 from Ascrinvacumab_HeavyChain1
  source 1..1329: mol_type = other RNA
caggtccagctccaggagtccggccccggcctcgtcaagccctcccagaccctctccctcacctgcaccgtctccggcggctccatctcctccggcgagtactactggaactggatccgccagcaccccggcaagggcctcgagtggatcggctacatctactactccggctccacctactacaacccctccctcaagtcccgcgtcaccatctccgtcgacacctccaagaaccagttctccctcaagctctcctccgtcaccgccgccgacaccgccgtctactactgcgcccgcgagtccgtcgccggcttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15335 - RNA, 645 nt, synthetic construct
  misc_feature 1..645: note = derived and/or modified sequence opt2 from Ascrinvacumab_LightChain1
  source 1..645: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcacctcctcccgcgccaccggcatccccgaccgcttctccggctccggctccggcaccgacttcaccctcaccatctcccgcctcgagcccgaggacttcgccgtctactactgccagcagtacggctcctcccccatcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15336 - RNA, 1314 nt, synthetic construct
  misc_feature 1..1314: note = derived and/or modified sequence opt2 from Aselizuab_HeavyChain1
  source 1..1314: mol_type = other RNA
gaggtccagctcgtcgagtccggcggcggcctcgtccagcccggcggctccctccgcctctcctgcgccgcctccggcttcaccttctccacctacgcctcctgggtccgccaggcccccggcaagggcctcgagtgggtcgcctccatctccaccggcggctccacctactaccccgactccgtcaagggccgcttcaccatctcccgcgacaacgccaagaacaccctctacctccagaactccctccgcgccgaggacaccgccgtctactactgcgcccgcgactacgacggctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtccacgaggccctccacaaccactacacccagaagtccctctccctctccctcggcaag

SEQ ID NO: 15337 - RNA, 1311 nt, synthetic construct
  misc_feature 1..1311: note = derived and/or modified sequence opt2 from Aselizuab_HeavyChain2
  source 1..1311: mol_type = other RNA
gaggtccagctcgtcgagtccggcggcggcctcgtccagcccggcggctccctccgcctctcctgcgccgcctccggcttcaccttctccacctacgcctcctgggtccgccaggcccccggcaagggcctcgagtgggtcgcctccatctccaccggcggctccacctactaccccgactccgtcaagggccgcttcaccatctcccgcgacaacgccaagaacaccctctacctccagaactccctccgcgccgaggacaccgccgtctactactgcgcccgcgactacgacggctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtccacgaggccctccacaaccactacacccagaagtccctctccctctccctcggcaag

SEQ ID NO: 15338 - RNA, 648 nt, synthetic construct
  misc_feature 1..648: note = derived and/or modified sequence opt2 from Aselizuab_LightChain1
  source 1..648: mol_type = other RNA
gacatccagacccagtccccctcctccctctccgcctccgtcggcgaccgcgtcaccatcacctgcaaggcctcccagtccgtcgactacgacggcgactcctacaactggtaccagcagaagcccggcaaggcccccaagctcctcatctacgccgcctccaacctcgagtccggcatcccctcccgcttctccggctccggctccggcaccgacttcaccctcaccatctcctccctccagcccgaggacttcgccacctactactgccagcagtccaacgaggacccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15339 - RNA, 1344 nt, synthetic construct
  misc_feature 1..1344: note = derived and/or modified sequence opt2 from Atezolizumab_HeavyChain1
  source 1..1344: mol_type = other RNA
gaggtccagctcgtcgagtccggcggcggcctcgtccagcccggcggctccctccgcctctcctgcgccgcctccggcttcaccttctccgactcctggatccactgggtccgccaggcccccggcaagggcctcgagtgggtcgcctggatctccccctacggcggctccacctactacgccgactccgtcaagggccgcttcaccatctccgccgacacctccaagaacaccgcctacctccagatgaactccctccgcgccgaggacaccgccgtctactactgcgcccgccgccactggcccggcggcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15340 - RNA, 642 nt, synthetic construct
  misc_feature 1..642: note = derived and/or modified sequence opt2 from Atezolizumab_LightChain1
  source 1..642: mol_type = other RNA
gacatccagatgacccagtccccctcctccctctccgcctccgtcggcgaccgcgtcaccatcacctgccgcgcctcccaggacgtctccaccgccgtcgcctggtaccagcagaagcccggcaaggcccccaagctcctcatctactccgcctccttcctctactccggcgtcccctcccgcttctccggctccggctccggcaccgacttcaccctcaccatctcctccctccagcccgaggacttcgccacctactactgccagcagtacctctaccaccccgccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15341 - RNA, 1323 nt, synthetic construct
  misc_feature 1..1323: note = derived and/or modified sequence opt2 from Atinumab_HeavyChain1
  source 1..1323: mol_type = other RNA
gaggtccagctcgtcgagtccggcggcggcctcgtccagcccggcggctccctccgcctctcctgcgccgcctccggcttcaccttctccaactactggatgtcctgggtccgccaggcccccggcaagggcctcgagtgggtcgccaccatcaagcaggacggctcccagaagaactacgtcgactccgtcaagggccgcttcaccatctcccgcgacaacgccaagaactccctctacctccgcctcaactccctccgcgccgaggacaccgccgtctactactgcgccaccgagctcttcgacctctggggccgcggctccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15342 - RNA, 642 nt, synthetic construct
  misc_feature 1..642: note = derived and/or modified sequence opt2 from Atinumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccatcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15343 - RNA, 1329 nt, synthetic construct
  misc_feature 1..1329: note = derived and/or modified sequence opt2 from Atlizuab_HeavyChain1
  source 1..1329: mol_type = other RNA
gtccagctccaggagtccggccccggcctcgtccgcccctcccagaccctctccctcacctgcaccgtctccggctactccatcacctccgaccacgcctggtcctgggtccgccagccccccggccgcggcctcgagtggatcggctacatctcctactccggcatcaccacctacaacccctccctcaagtcccgcgtcaccctccgcgacacctccaagaaccagttctccctccgcctctcctccgtcaccgccgccgacaccgccgtctactactgcgcccgctccctcgcccgcaccaccgccgactactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 15344 - RNA, 639 nt, synthetic construct
  misc_feature 1..639: note = derived and/or modified sequence opt2 from Atlizuab_LightChain1
  source 1..639: mol_type = other RNA
gacatccagacccagtccccctcctccctctccgcctccgtcggcgaccgcgtcaccatcacctgccgcgcctcccaggacatctcctcctacctcaactggtaccagcagaagcccggcaaggcccccaagctcctcatctactacacctcccgcctccactccggcgtcccctcccgcttctccggctccggctccggcaccgacttcaccttcaccatctcctccctccagcccgaggacatcgccacctactactgccagcagggcaacaccctcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15345 - RNA, 792 nt, synthetic construct
  misc_feature 1..792: note = derived and/or modified sequence opt2 from Aurograb_SingleChain
  source 1..792: mol_type = other RNA
atggccaaggtccagctcctccagtccgccaccgaggtcaagaagcccggcgcctccgtcaaggtctcctgcaaggcctacggctacaccttcaccgactacggcatcacctgggtccgccaggcccccggccagggcctcgagtggatgggctggatctccgcctacaacggctacaccaactacgcccagaagttccaggaccgcatcaccatgaccaccgacgcctccacctccaccgcctacatggagctccgctccctccgccccgacgacaccgccgtcctctactgcgcccgcgaccgcgaggacgcctccctcctccgcgacggccactggggccagggcaccctcgtcaccgtctcctccggcggcggcggctccggcggcggcggctccggcggcggcggctccggcggcggcggctccgagaccaccctcacccagtcccccggcaccctctccctctcccccggcgagcgcgccaccctctcctgccgcgcctcccagatcgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctccaagctcgagcccgaggacttcgccgtctactactgccagcactacggctcctcctccccctggacctcccgcccccgcgaccagtccgacatcaagcgcgccgccgccctcgagcaccaccaccaccaccac

SEQ ID NO: 15346 - RNA, 1350 nt, synthetic construct
  misc_feature 1..1350: note = derived and/or modified sequence opt2 from Avelumab_HeavyChain1
  source 1..1350: mol_type = other RNA
gaggtccagctcctcgagtccggcggcggcctcgtccagcccggcggctccctccgcctctcctgcgccgcctccggcttcaccttctcctcctacatcatgatgtgggtccgccaggcccccggcaagggcctcgagtgggtctcctccatctacccctccggcggcatcaccttctacgccgacaccgtcaagggccgcttcaccatctcccgcgacaactccaagaacaccctctacctccagatgaactccctccgcgccgaggacaccgccgtctactactgcgcccgcatcaagctcggcaccgtcaccaccgtcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15347 - RNA, 648 nt, synthetic construct
  misc_feature 1..648: note = derived and/or modified sequence opt2 from Avelumab_LightChain1
  source 1..648: mol_type = other RNA
cagtccgccctcacccagcccgcctccgtctccggctcccccggccagtccatcaccatctcctgcaccggcacctcctccgacgtcggcggctacaactacgtctcctggtaccagcagcaccccggcaaggcccccaagctcatgatctacgacgtctccaaccgcccctccggcgtctccaaccgcttctccggctccaagtccggcaacaccgcctccctcaccatctccggcctccaggccgaggacgaggccgactactactgctcctcctacacctcctcctccacccgcgtcttcggcaccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15348 - RNA, 1344 nt, synthetic construct
  misc_feature 1..1344: note = derived and/or modified sequence opt2 from Bapineuzumab_HeavyChain1
  source 1..1344: mol_type = other RNA
gaggtccagctcctcgagtccggcggcggcctcgtccagcccggcggctccctccgcctctcctgcgccgcctccggcttcaccttctccaactacggcatgtcctgggtccgccaggcccccggcaagggcctcgagtgggtcgcctccatccgctccggcggcggccgcacctactactccgacaacgtcaagggccgcttcaccatctcccgcgacaactccaagaacaccctctacctccagatgaactccctccgcgccgaggacaccgccgtctactactgcgtccgctacgaccactactccggctcctccgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15349 - RNA, 657 nt, synthetic construct
  misc_feature 1..657: note = derived and/or modified sequence opt2 from Bapineuzumab_LightChain1
  source 1..657: mol_type = other RNA
gacgtcgtcatgacccagtcccccctctccctccccgtcacccccggcgagcccgcctccatctcctgcaagtcctcccagtccctcctcgactccgacggcaagacctacctcaactggctcctccagaagcccggccagtccccccagcgcctcatctacctcgtctccaagctcgactccggcgtccccgaccgcttctccggctccggctccggcaccgacttcaccctcaagatctcccgcgtcgaggccgaggacgtcggcgtctactactgctggcagggcacccacttcccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15350 - RNA, 1338 nt, synthetic construct
  misc_feature 1..1338: note = derived and/or modified sequence opt2 from Basiliximab_HeavyChain
  source 1..1338: mol_type = other RNA
cagctccagcagtccggcaccgtcctcgcccgccccggcgcctccgtcaagatgtcctgcaaggcctccggctactccttcacccgctactggatgcactggatcaagcagcgccccggccagggcctcgagtggatcggcgccatctaccccggcaactccgacacctcctacaaccagaagttcgagggcaaggccaagctcaccgccgtcacctccgcctccaccgcctacatggagctctcctccctcacccacgaggactccgccgtctactactgctcccgcgactacggctactacttcgacttctggggccagggcaccaccctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagccccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15351 - RNA, 630 nt, synthetic construct
  misc_feature 1..630: note = derived and/or modified sequence opt2 from Basiliximab_LightChain
  source 1..630: mol_type = other RNA
cagatcgtctccacccagtcccccgccatcatgtccgcctcccccggcgagaaggtcaccatgacctgctccgcctcctcctcccgctcctacatgcagtggtaccagcagaagcccggcacctcccccaagcgctggatctacgacacctccaagctcgcctccggcgtccccgcccgcttctccggctccggctccggcacctcctactccctcaccatctcctccatggaggccgaggacgccgccacctactactgccaccagcgctcctcctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgag

SEQ ID NO: 15352 - RNA, 1350 nt, synthetic construct
  misc_feature 1..1350: note = derived and/or modified sequence opt2 from Bavituximab_HeavyChain
  source 1..1350: mol_type = other RNA
gaggtccagctccagcagtccggccccgagctcgagaagcccggcgcctccgtcaagctctcctgcaaggcctccggctactccttcaccggctacaacatgaactgggtcaagcagtcccacggcaagtccctcgagtggatcggccacatcgacccctactacggcgacacctcctacaaccagaagttccgcggcaaggccaccctcaccgtcgacaagtcctcctccaccgcctacatgcagctcaagtccctcacctccgaggactccgccgtctactactgcgtcaagggcggctactacggccactggtacttcgacgtctggggcgccggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15353 - RNA, 642 nt, synthetic construct
  misc_feature 1..642: note = derived and/or modified sequence opt2 from Bavituximab_LightChain
  source 1..642: mol_type = other RNA
gacatccagatgacccagtccccctcctccctctccgcctccctcggcgagcgcgtctccctcacctgccgcgcctcccaggacatcggctcctccctcaactggctccagcagggccccgacggcaccatcaagcgcctcatctacgccacctcctccctcgactccggcgtccccaagcgcttctccggctcccgctccggctccgactactccctcaccatctcctccctcgagtccgaggacttcgtcgactactactgcctccagtacgtctcctccccccccaccttcggcgccggcaccaagctcgagctcaagcgcgccgacgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15354 - RNA, 624 nt, synthetic construct
  misc_feature 1..624: note = derived and/or modified sequence opt2 from Bavituximab_LightChain_variant_8734_L
  source 1..624: mol_type = other RNA
gacatccagatgacccagtccccctcctccctctccgcctccctcggcgagcgcgtctccctcacctgccgcgcctcccaggacatcggctcctccctcaactggctccagcagggccccgacggcaccatcaagcgcctcatctacgccacctcctccctcgactccggcgtccccaagcgcttctccggctcccgctccggctccgactactccctcaccatctcctccctcgagtccgaggacttcgtcgactactactgcctccagtacgtctcctccccccccaccttcggcgccggcaccaagctcgagctcaagcgcgccgacgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctccaaggccgactacgagaagcacaaggtctacgcctgcgaggtcacccaccagggcctctcctcccccgtcaccaagtccttcaaccgcggcgagtgc

SEQ ID NO: 15355 - RNA, 1368 nt, synthetic construct
  misc_feature 1..1368: note = derived and/or modified sequence opt2 from Begelomab_HeavyChain1
  source 1..1368: mol_type = other RNA
caggtccagctccagcagtccggcgccgagctcgtcaagcccggcgcctccgtcaagctctcctgcaaggcctccggctacaccttccgctcctacgacatcaactgggtccgccagcgccccgagcagggcctcgagtggatcggctggatcttccccggcgacggctccaccaagtacaacgagaagttcaagggcaaggccaccctcaccaccgacaagtcctcctccaccgcctacatgcagctctcccgcctcacctccgaggactccgccgtctacttctgcgcccgctggaccgtcgtcggccccggctacttcgacgtctggggcgccggcaccaccgtcaccgtctcctccgccaagaccacccccccctccgtctaccccctcgcccccggctgcggcgacaccaccggctcctccgtcaccctcggctgcctcgtcaagggctacttccccgagtccgtcaccgtcacctggaactccggctccctctcctcctccgtccacaccttccccgccctcctccagtccggcctctacaccatgtcctcctccgtcaccgtcccctcctccacctggccctcccagaccgtcacctgctccgtcgcccaccccgcctcctccaccaccgtcgacaagaagctcgagccctccggccccatctccaccatcaacccctgccccccctgcaaggagtgccacaagtgccccgcccccaacctcgagggcggcccctccgtcttcatcttcccccccaacatcaaggacgtcctcatgatctccctcacccccaaggtcacctgcgtcgtcgtcgacgtctccgaggacgaccccgacgtccagatctcctggttcgtcaacaacgtcgaggtccacaccgcccagacccagacccaccgcgaggactacaactccaccatccgcgtcgtctccaccctccccatccagcaccaggactggatgtccggcaaggagttcaagtgcaaggtcaacaacaaggacctcccctcccccatcgagcgcaccatctccaagatcaagggcctcgtccgcgccccccaggtctacatcctccccccccccgccgagcagctctcccgcaaggacgtctccctcacctgcctcgtcgtcggcttcaaccccggcgacatctccgtcgagtggacctccaacggccacaccgaggagaactacaaggacaccgcccccgtcctcgactccgacggctcctacttcatctactccaagctcaacatgaagacctccaagtgggagaagaccgactccttctcctgcaacgtccgccacgagggcctcaagaactactacctcaagaagaccatctcccgctcccccggcaag

SEQ ID NO: 15356 - RNA, 639 nt, synthetic construct; identical to SEQ ID NO: 15294
  misc_feature 1..639: note = derived and/or modified sequence opt2 from Begelomab_LightChain1
  source 1..639: mol_type = other RNA

SEQ ID NO: 15357 - RNA, 1353 nt, synthetic construct
  misc_feature 1..1353: note = derived and/or modified sequence opt2 from Benralizumab_HeavyChain1
  source 1..1353: mol_type = other RNA
gaggtccagctcgtccagtccggcgccgaggtcaagaagcccggcgcctccgtcaaggtctcctgcaaggcctccggctacaccttcacctcctacgtcatccactgggtccgccagcgccccggccagggcctcgcctggatgggctacatcaacccctacaacgacggcaccaagtacaacgagcgcttcaagggcaaggtcaccatcacctccgaccgctccacctccaccgtctacatggagctctcctccctccgctccgaggacaccgccgtctacctctgcggccgcgagggcatccgctactacggcctcctcggcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15358 - RNA, 642 nt, synthetic construct
  misc_feature 1..642: note = derived and/or modified sequence opt2 from Benralizumab_LightChain1
  source 1..642: mol_type = other RNA
gacatccagatgacccagtccccctcctccctctccgcctccgtcggcgaccgcgtcaccatcacctgcggcacctccgaggacatcatcaactacctcaactggtaccagcagaagcccggcaaggcccccaagctcctcatctaccacacctcccgcctccagtccggcgtcccctcccgcttctccggctccggctccggcaccgacttcaccctcaccatctcctccctccagcccgaggacttcgccacctactactgccagcagggctacaccctcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15359 - RNA, 1329 nt, synthetic construct
  misc_feature 1..1329: note = derived and/or modified sequence opt2 from Betalutin_HeavyChain1
  source 1..1329: mol_type = other RNA
gagatccagctccagcagtccggccccgagctcgtcaagcccggcgcctccgtcaaggtctcctgcaaggcctccggctactccttcaccgactacaacatgtactgggtcaagcagtcccacggcaagtccctcgagtggatcggctacatcgacccctacaacggcgacaccacctacaaccagaagttcaagggcaaggccaccctcaccgtcgacaagtcctcctccaccgccttcatccacctcaactccctcacctccgaggactccgccgtctactactgcgcccgctccccctacggccactacgccatggactactggggccagggcacctccgtcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctggttcgtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatggacaccgacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 15360 - RNA, 642 nt, synthetic construct
  misc_feature 1..642: note = derived and/or modified sequence opt2 from Betalutin_LightChain1
  source 1..642: mol_type = other RNA
gacatcgtcatgacccagtcccacaagctcctctccacctccgtcggcgaccgcgtctccatcacctgcaaggcctcccaggacgtctccaccgccgtcgactggtaccagcagaagcccggccagtcccccaagctcctcatcaactgggcctccacccgccacaccggcgtccccgaccgcttcaccggctccggctccggcaccgactacaccctcaccatctcctccatgcaggccgaggacctcgccctctactactgccgccagcactactccacccccttcaccttcggctccggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15361 - RNA, 1344 nt, synthetic construct
  misc_feature 1..1344: note = derived and/or modified sequence opt2 from Bevacituzuab_HeavyChain1
  source 1..1344: mol_type = other RNA
gaggtccagctcgtcgagtccggcggcggcctcgtccagcccggcggctccctccgcctctcctgcgccgcctccggctacaccttcaccaactacggcaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 15362 - RNA, 639 nt, synthetic construct
  misc_feature 1..639: note = derived and/or modified sequence opt2 from Bevacituzuab_LightChain1
  source 1..639: mol_type = other RNA
gacatccagacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15363 - RNA, 639 nt, synthetic construct
  misc_feature 1..639: note = derived and/or modified sequence opt2 from Bevacizumab_154-aspartic_acid_LightChain
  source 1..639: mol_type = other RNA
gacatccagatgacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccgaccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgag

SEQ ID NO: 15364 - RNA, 639 nt, synthetic construct; identical to SEQ ID NO: 15363
  misc_feature 1..639: note = derived and/or modified sequence opt2 from Bevacizumab_154-substitution_deriv_LightChain
  source 1..639: mol_type = other RNA

SEQ ID NO: 15365 - RNA, 672 nt, synthetic construct
  misc_feature 1..672: note = derived and/or modified sequence opt2 from Bevacizumab_180-serine_HeavyChain
  source 1..672: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtctcccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 15366 - RNA, 672 nt, synthetic construct; identical to SEQ ID NO: 15365
  misc_feature 1..672: note = derived and/or modified sequence opt2 from Bevacizumab_180-substitution_deriv_HeavyCahin
  source 1..672: mol_type = other RNA

SEQ ID NO: 15367 - RNA, 1359 nt, synthetic construct
  misc_feature 1..1359: note = derived and/or modified sequence opt2 from Bevacizumab_beta_HeavyChain1
  source 1..1359: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15368 - RNA, 642 nt, synthetic construct
  misc_feature 1..642: note = derived and/or modified sequence opt2 from Bevacizumab_beta_LightChain1
  source 1..642: mol_type = other RNA
gacatccagatgacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15369 - RNA, 687 nt, synthetic construct
  misc_feature 1..687: note = derived and/or modified sequence opt2 from Bevacizumab_FcDomain
  source 1..687: mol_type = other RNA
tcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15370 - RNA, 672 nt, synthetic construct
  misc_feature 1..672: note = derived and/or modified sequence opt2 from Bevacizumab_HeavyChain
  source 1..672: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 15371 - RNA, 1428 nt, synthetic construct
  misc_feature 1..1428: note = derived and/or modified sequence opt2 from Bevacizumab_HeavyChain_variant1
  source 1..1428: mol_type = other RNA
gcctccgccaccatgggctggtcctgcatcatcctcttcctcgtcgccaccgccaccggcgtccactccgaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15372 - RNA, 369 nt, synthetic construct
  misc_feature 1..369: note = derived and/or modified sequence opt2 from Bevacizumab_HeavyChain_V-Region
  source 1..369: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctcc

SEQ ID NO: 15373 - RNA, 717 nt, synthetic construct
  misc_feature 1..717: note = derived and/or modified sequence opt2 from Bevacizumab_LightChain1
  source 1..717: mol_type = other RNA
gcctccaagctcgccaccatgggctggtcctgcatcatcctcttcctcgtcgccaccgccaccggcgtccactccgacatccagatgacccagtccccctcctccctctccgcctccgtcggcgaccgcgtcaccatcacctgccgcgcctcccaggacatctcctcctacctcaactggtaccagcagaagcccggcaaggcccccaagctcctcatctactacacctcccgcctccactccggcgtcccctcccgcttctccggctccggctccggcaccgacttcaccttcaccatctcctccctccagcccgaggacatcgccacctactactgccagcagggcaacaccctcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15374 - RNA, 711 nt, synthetic construct
  misc_feature 1..711: note = derived and/or modified sequence opt2 from Bevacizumab_LightChain2
  source 1..711: mol_type = other RNA
gcctccgccaccatgggctggtcctgcatcatcctcttcctcgtcgccaccgccaccggcgtccactccgacatccagatgacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15375 - RNA, 642 nt, synthetic construct; identical to SEQ ID NO: 15368
  misc_feature 1..642: note = derived and/or modified sequence opt2 from Bevacizumab_LightChain
  source 1..642: mol_type = other RNA

SEQ ID NO: 15376 - RNA, 324 nt, synthetic construct
  misc_feature 1..324: note = derived and/or modified sequence opt2 from Bevacizumab_LightChain_VJ-Region
  source 1..324: mol_type = other RNA
gacatccagatgacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgc

SEQ ID NO: 15377 - RNA, 321 nt, synthetic construct
  misc_feature 1..321: note = derived and/or modified sequence opt2 from Bevacizumab_LightChain_V-Region
  source 1..321: mol_type = other RNA
gacatccagatgacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaag

SEQ ID NO: 15378 - RNA, 369 nt, synthetic construct; identical to SEQ ID NO: 15372
  misc_feature 1..369: note = derived and/or modified sequence opt2 from Bevacizumab-rhuMAb-VEGF_HeavyChain_gamma1-Chain_VDJ-Region
  source 1..369: mol_type = other RNA

SEQ ID NO: 15379 - RNA, 321 nt, synthetic construct; identical to SEQ ID NO: 15377
  misc_feature 1..321: note = derived and/or modified sequence opt2 from Bevacizumab-rhuMAb-VEGF_LightChain_VJ-Region
  source 1..321: mol_type = other RNA

SEQ ID NO: 15380 - RNA, 1341 nt, synthetic construct
  misc_feature 1..1341: note = derived and/or modified sequence opt2 from Bevacizumab_gamma1-Chain
  source 1..1341: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggctccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactcctacgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcaagaagctcaccgtcgacaagtcccgctggcagcagggcaacgtcttctcctgctccgtcatgcacgaggccctccacaaccactacacccagaagtccctctccctctcccccggcaag

SEQ ID NO: 15381 - RNA, 1359 nt, synthetic construct
  misc_feature 1..1359: note = derived and/or modified sequence opt2 from Bevacizumab_gamma1-Chain_CH3-Region_mutein
  source 1..1359: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctgcaccctccccccctcccgcgacgagctcaccaagaaccaggtctccctctcctgcgccgtcaagggcttctacccctccgacatcgccgtcgagtgggagtccaacggccagcccgagaacaactacaagaccaccccccccgtcctcgactccgacggctccttcttcctcgtctccaagctcaccgtcgacaagtcccgctggcagcagggcaacgtcttctcctgctccgtcatgcacgaggccctccacaaccactacacccagaagtccctctccctctcccccggcaag

SEQ ID NO: 15382 - RNA, 1347 nt, synthetic construct; identical to SEQ ID NO: 15295
  misc_feature 1..1347: note = derived and/or modified sequence opt2 from Bezlotoxumab_HeavyChain1
  source 1..1347: mol_type = other RNA

SEQ ID NO: 15383 - RNA, 645 nt, synthetic construct; identical to SEQ ID NO: 15296
  misc_feature 1..645: note = derived and/or modified sequence opt2 from Bezlotoxumab_LightChain1
  source 1..645: mol_type = other RNA

SEQ ID NO: 15384 - RNA, 1335 nt, synthetic construct
  misc_feature 1..1335: note = derived and/or modified sequence opt2 from Bimagrumab_HeavyChain1
  source 1..1335: mol_type = other RNA
caggtccagctcgtccagtccggcgccgaggtcaagaagcccggcgcctccgtcaaggtctcctgcaaggcctccggctacaccttcacctcctcctacatcaactgggtccgccaggcccccggccagggcctcgagtggatgggcaccatcaaccccgtctccggctccacctcctacgcccagaagttccagggccgcgtcaccatgacccgcgacacctccatctccaccgcctacatggagctctcccgcctccgctccgacgacaccgccgtctactactgcgcccgcggcggctggttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15385 - RNA, 1332 nt, synthetic construct
  misc_feature 1..1332: note = derived and/or modified sequence opt2 from Bimagrumab_HeavyChain
  source 1..1332: mol_type = other RNA
caggtccagctcgtccagtccggcgccgaggtcaagaagcccggcgcctccgtcaaggtctcctgcaaggcctccggctacaccttcacctcctcctacatcaactgggtccgccaggcccccggccagggcctcgagtggatgggcaccatcaaccccgtctccggctccacctcctacgcccagaagttccagggccgcgtcaccatgacccgcgacacctccatctccaccgcctacatggagctctcccgcctccgctccgacgacaccgccgtctactactgcgcccgcggcggctggttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15386 - RNA, 651 nt, synthetic construct
  misc_feature 1..651: note = derived and/or modified sequence opt2 from Bimagrumab_LightChain1
  source 1..651: mol_type = other RNA
cagtccgccctcacccagcccgcctccgtctccggctcccccggccagtccatcaccatctcctgcaccggcacctcctccgacgtcggctcctacaactacgtcaactggtaccagcagcaccccggcaaggcccccaagctcatgatctacggcgtctccaagcgcccctccggcgtctccaaccgcttctccggctccaagtccggcaacaccgcctccctcaccatctccggcctccaggccgaggacgaggccgactactactgcggcaccttcgccggcggctcctactacggcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15387 - RNA, 1365 nt, synthetic construct
  misc_feature 1..1365: note = derived and/or modified sequence opt2 from Bimekizumab_HeavyChain1
  source 1..1365: mol_type = other RNA
gaggtccagctcgtcgagtccggcggcggcctcgtccagcccggcggctccctccgcctctcctgcgccgcctccggcttcaccttctccgactacaacatggcctgggtccgccaggcccccggcaagggcctcgagtgggtcgccaccatcacctacgagggccgcaacacctactaccgcgactccgtcaagggccgcttcaccatctcccgcgacaacgccaagaactccctctacctccagatgaactccctccgcgccgaggacaccgccgtctactactgcgcctcccccccccagtactacgagggctccatctaccgcctctggttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15388 - RNA, 642 nt, synthetic construct
  misc_feature 1..642: note = derived and/or modified sequence opt2 from Bimekizumab_LightChain1
  source 1..642: mol_type = other RNA
gccatccagctcacccagtccccctcctccctctccgcctccgtcggcgaccgcgtcaccatcacctgccgcgccgacgagtccgtccgcaccctcatgcactggtaccagcagaagcccggcaaggcccccaagctcctcatctacctcgtctccaactccgagatcggcgtccccgaccgcttctccggctccggctccggcaccgacttccgcctcaccatctcctccctccagcccgaggacttcgccacctactactgccagcagacctggtccgacccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15389 - RNA, 1344 nt, synthetic construct
  misc_feature 1..1344: note = derived and/or modified sequence opt2 from Bleselumab_HeavyChain1
  source 1..1344: mol_type = other RNA
cagctccagctccaggagtccggccccggcctcctcaagccctccgagaccctctccctcacctgcaccgtctccggcggctccatctcctcccccggctactacggcggctggatccgccagccccccggcaagggcctcgagtggatcggctccatctacaagtccggctccacctaccacaacccctccctcaagtcccgcgtcaccatctccgtcgacacctccaagaaccagttctccctcaagctctcctccgtcaccgccgccgacaccgccgtctactactgcacccgccccgtcgtccgctacttcggctggttcgacccctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcgagggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15390 - RNA, 639 nt, synthetic construct
  misc_feature 1..639: note = derived and/or modified sequence opt2 from Bleselumab_LightChain1
  source 1..639: mol_type = other RNA
gccatccagctcacccagtccccctcctccctctccgcctccgtcggcgaccgcgtcaccatcacctgccgcgcctcccagggcatctcctccgccctcgcctggtaccagcagaagcccggcaaggcccccaagctcctcatctacgacgcctccaacctcgagtccggcgtcccctcccgcttctccggctccggctccggcaccgacttcaccctcaccatctcctccctccagcccgaggacttcgccacctactactgccagcagttcaactcctaccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15391 - RNA, 1512 nt, synthetic construct
  misc_feature 1..1512: note = derived and/or modified sequence opt2 from Blinatumomab_HeavyChain1
  source 1..1512: mol_type = other RNA
gacatccagctcacccagtcccccgcctccctcgccgtctccctcggccagcgcgccaccatctcctgcaaggcctcccagtccgtcgactacgacggcgactcctacctcaactggtaccagcagatccccggccagccccccaagctcctcatctacgacgcctccaacctcgtctccggcatccccccccgcttctccggctccggctccggcaccgacttcaccctcaacatccaccccgtcgagaaggtcgacgccgccacctaccactgccagcagtccaccgaggacccctggaccttcggcggcggcaccaagctcgagatcaagggcggcggcggctccggcggcggcggctccggcggcggcggctcccaggtccagctccagcagtccggcgccgagctcgtccgccccggctcctccgtcaagatctcctgcaaggcctccggctacgccttctcctcctactggatgaactgggtcaagcagcgccccggccagggcctcgagtggatcggccagatctggcccggcgacggcgacaccaactacaacggcaagttcaagggcaaggccaccctcaccgccgacgagtcctcctccaccgcctacatgcagctctcctccctcgcctccgaggactccgccgtctacttctgcgcccgccgcgagaccaccaccgtcggccgctactactacgccatggactactggggccagggcaccaccgtcaccgtctcctccggcggcggcggctccgacatcaagctccagcagtccggcgccgagctcgcccgccccggcgcctccgtcaagatgtcctgcaagacctccggctacaccttcacccgctacaccatgcactgggtcaagcagcgccccggccagggcctcgagtggatcggctacatcaacccctcccgcggctacaccaactacaaccagaagttcaaggacaaggccaccctcaccaccgacaagtcctcctccaccgcctacatgcagctctcctccctcacctccgaggactccgccgtctactactgcgcccgctactacgacgaccactactgcctcgactactggggccagggcaccaccctcaccgtctcctccgtcgagggcggctccggcggctccggcggctccggcggctccggcggcgtcgacgacatccagctcacccagtcccccgccatcatgtccgcctcccccggcgagaaggtcaccatgacctgccgcgcctcctcctccgtctcctacatgaactggtaccagcagaagtccggcacctcccccaagcgctggatctacgacacctccaaggtcgcctccggcgtcccctaccgcttctccggctccggctccggcacctcctactccctcaccatctcctccatggaggccgaggacgccgccacctactactgccagcagtggtcctccaaccccctcaccttcggcgccggcaccaagctcgagctcaagcaccaccaccaccaccac

SEQ ID NO: 15392 - RNA, 1512 nt, synthetic construct; identical to SEQ ID NO: 15391
  misc_feature 1..1512: note = derived and/or modified sequence opt2 from Blinatumomab_SingleChain
  source 1..1512: mol_type = other RNA

SEQ ID NO: 15393 - RNA, 1512 nt, synthetic construct; identical to SEQ ID NO: 15391
  misc_feature 1..1512: note = derived and/or modified sequence opt2 from Blinatumumab_SingleChain_variable_fragment_fusion_protein_( bite)
  source 1..1512: mol_type = other RNA

SEQ ID NO: 15394 - RNA, 1344 nt, synthetic construct
  misc_feature 1..1344: note = derived and/or modified sequence opt2 from Blontuvetmab_HeavyChain
  source 1..1344: mol_type = other RNA
caggtccagctccagcagtcccgcgccgagctcgtccgccccggcgcctccgtcaccctctcctgcaagccctccggctacaccttcaccgactacgaggtccactgggtcaagcagacccccgtccacggcctcgagtggatcggcgccatcgaccccgagaccggcggcaccgccgacaaccagaagttcaagggcaaggccatcctcaccgccgacaagtcctcctccaccgcctacatggagctccgctccctcacctccgaggactccgccgtctactactgcaccaacttcgtcgacgtctggggcaccggcaccaccgtcaccgtctcctccgcctccaccaccgccccctccgtcttccccctcgccccctcctgcggctcccagtccggctccaccgtcgccctcgcctgcctcgtctccggctacttccccgagcccgtcaccgtctcctggaactccggctccctcacctccggcgtccacaccttcccctccgtcctccagtcctccggcctctactccctctcctccatggtcaccgtcccctcctcccgctggccctccgagaccttcacctgcaacgtcgcccaccccgcctccaagaccaaggtcgacaagcccgtccccaagcgcgagaacggccgcgtcccccgcccccccgactgccccaagtgccccgcccccgagatgctcggcggcccctccgtcttcatcttcccccccaagcccaaggacaccctcctcatcgcccgcacccccgaggtcacctgcgtcgtcgtcgacctcgaccccgaggaccccgaggtccagatctcctggttcgtcgacggcaagcagatgcagaccgccaagacccagccccgcgaggagcagttcaacggcacctaccgcgtcgtctccgtcctccccatcggccaccaggactggctcaagggcaagcagttcacctgcaaggtcaacaacaaggccctcccctcccccatcgagcgcaccatctccaaggcccgcggccaggcccaccagccctccgtctacgtcctccccccctcccgcgaggagctctccaagaacaccgtctccctcacctgcctcatcaaggacttcttcccccccgacatcgacgtcgagtggcagtccaacggccagcaggagcccgagtccaagtaccgcaccacccccccccagctcgacgaggacggctcctacttcctctactccaagctctccgtcgacaagtcccgctggcagcgcggcgacaccttcatctgcgccgtcatgcacgaggccctccacaaccactacacccagaagtccctctcccactcccccggcaag

SEQ ID NO: 15395 - RNA, 657 nt, synthetic construct
  misc_feature 1..657: note = derived and/or modified sequence opt2 from Blontuvetmab_LightChain
  source 1..657: mol_type = other RNA
gacgtcgtcatgtcccagtccccctcctccctcgccgtctccgtcggcgagaaggtcaccatgtcctgcaagtcctcccagtccctcctctactccggcaaccagaagaactacctcgcctggtaccagcagaagcccggccagtccccccgcctcctcatctactgggcctccacccgcgagtccggcgtccccgaccgcttcaccggctccggctccggcaccgacttcaccctcaccatctcctccgtcaaggccgaggacctcgccgtcttctactgccagcagtactacaactaccccctcaccttcggcggcggcacccacctcaccgtcctcggccagcccaaggcctccccctccgtcaccctcttccccccctcctccgaggagctcggcgccaacaaggccaccctcgtctgcctcatctccgacttctacccctccggcgtcaccgtcgcctggaaggccgacggctcccccatcacccagggcgtcgagaccaccaagccctccaagcagtccaacaacaagtacgccgcctcctcctacctctccctcacccccgacaagtggaagtcccactcctccttctcctgcctcgtcacccacgagggctccaccgtcgagaagaaggtcgcccccgccgagtgctcc

SEQ ID NO: 15396 - RNA, 1332 nt, synthetic construct
  misc_feature 1..1332: note = derived and/or modified sequence opt2 from Blosozumab_HeavyChain1
  source 1..1332: mol_type = other RNA
caggtccagctcgtccagtccggcgccgaggtcaagaagcccggcgcctccgtcaaggtctcctgcaaggtctccggcttccccatcaaggacaccttccagcactgggtccgccaggcccccggcaagggcctcgagtggatgggctggtccgaccccgagatcggcgacaccgagtacgcctccaagttccagggccgcgtcaccatgaccgaggacacctccaccgacaccgcctacatggagctctcctccctccgctccgaggacaccgccgtctactactgcgccaccggcgacaccacctacaagttcgacttctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15397 - RNA, 642 nt, synthetic construct
  misc_feature 1..642: note = derived and/or modified sequence opt2 from Blosozumab_LightChain1
  source 1..642: mol_type = other RNA
gacatccagatgacccagtccccctcctccctctccgcctccgtcggcgaccgcgtcaccatcacctgcaaggcctcccaggacgtccacaccgccgtcgcctggtaccagcagaagcccggcaaggcccccaagctcctcatctactgggcctccacccgctggaccggcgtcccctcccgcttctccggctccggctccggcaccgacttcaccctcaccatctcctccctccagcccgaggacttcgccacctactactgccagcagtactccgactacccctggaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15398 - RNA, 1332 nt, synthetic construct
  misc_feature 1..1332: note = derived and/or modified sequence opt2 from Bococizumab_HeavyChain1
  source 1..1332: mol_type = other RNA
caggtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatgggcgagatctcccccttcggcggccgcaccaactacaacgagaagttcaagtcccgcgtcaccatgacccgcgacacctccacctccaccgtctacatggagctctcctccctccgctccgaggacaccgccgtctactactgcgcccgcgagcgccccctctacgcctccgacctctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15399 - RNA, 642 nt, synthetic construct
  misc_feature 1..642: note = derived and/or modified sequence opt2 from Bococizumab_LightChain1
  source 1..642: mol_type = other RNA
gacatccagatgacccagtccccctcctccctctccgcctccgtcggcgaccgcgtcaccatcacctgccgcgcctcccagggcatctcctccgccctcgcctggtaccagcagaagcccggcaaggcccccaagctcctcatctactccgcctcctaccgctacaccggcgtcccctcccgcttctccggctccggctccggcaccgacttcaccttcaccatctcctccctccagcccgaggacatcgccacctactactgccagcagcgctactccctctggcgcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15400 - RNA, 1338 nt, synthetic construct
  misc_feature 1..1338: note = derived and/or modified sequence opt2 from Brentuximab_vedotin_HeavyChain1
  source 1..1338: mol_type = other RNA
cagatccagctccagcagtccggccccgaggtcgtcaagcccggcgcctccgtcaagatctcctgcaaggcctccggctacaccttcaccgactactacatcacctgggtcaagcagaagcccggccagggcctcgagtggatcggctggatctaccccggctccggcaacaccaagtacaacgagaagttcaagggcaaggccaccctcaccgtcgacacctcctcctccaccgccttcatgcagctctcctccctcacctccgaggacaccgccgtctacttctgcgccaactacggcaactactggttcgcctactggggccagggcacccaggtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15401 - RNA, 654 nt, synthetic construct
  misc_feature 1..654: note = derived and/or modified sequence opt2 from Brentuximab_vedotin_LightChain1
  source 1..654: mol_type = other RNA
gacatcgtcctcacccagtcccccgcctccctcgccgtctccctcggccagcgcgccaccatctcctgcaaggcctcccagtccgtcgacttcgacggcgactcctacatgaactggtaccagcagaagcccggccagccccccaaggtcctcatctacgccgcctccaacctcgagtccggcatccccgcccgcttctccggctccggctccggcaccgacttcaccctcaacatccaccccgtcgaggaggaggacgccgccacctactactgccagcagtccaacgaggacccctggaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15402 - RNA, 1335 nt, synthetic construct
  misc_feature 1..1335: note = derived and/or modified sequence opt2 from Briakinumab_HeavyChain1
  source 1..1335: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccttcatccgctacgacggctccaacaagtactacgccgactccgtcaagggccgcttcaccatctcccgcgacaactccaagaacaccctctacctccagatgaactccctccgcgccgaggacaccgccgtctactactgcaagacccacggctcccacgacaactggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15403 - RNA, 651 nt, synthetic construct
  misc_feature 1..651: note = derived and/or modified sequence opt2 from Briakinumab_LightChain1
  source 1..651: mol_type = other RNA
cagtccgtcctcacccagcccccctccgtctccggcgcccccggccagcgcgtcaccatctcctgctccggctcccgctccaacatcggctccaacaccgtcaagtggtaccagcagctccccggcaccgcccccaagctcctcatctactacaacgaccagcgcccctccggcgtccccgaccgcttctccggctccaagtccggcacctccgcctccctcgccatcaccggcctccaggccgaggacgaggccgactactactgccagtcctacgaccgctacacccaccccgccctcctcttcggcaccggcaccaaggtcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15404 - RNA, 1326 nt, synthetic construct
  misc_feature 1..1326: note = derived and/or modified sequence opt2 from Brodalumab_HeavyChain1
  source 1..1326: mol_type = other RNA
caggtccagctcgtccagtccggcgccgaggtcaagaagcccggcgcctccgtcaaggtctcctgcaaggcctccggctacaccttcacccgctacggcatctcctgggtccgccaggcccccggccagggcctcgagtggatgggctggatctccacctactccggcaacaccaactacgcccagaagctccagggccgcgtcaccatgaccaccgacacctccacctccaccgcctacatggagctccgctccctccgctccgacgacaccgccgtctactactgcgcccgccgccagctctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15405 - RNA, 642 nt, synthetic construct
  misc_feature 1..642: note = derived and/or modified sequence opt2 from Brodalumab_LightChain1
  source 1..642: mol_type = other RNA
gagatcgtcatgacccagtcccccgccaccctctccgtctcccccggcgagcgcgccaccctctcctgccgcgcctcccagtccgtctcctccaacctcgcctggttccagcagaagcccggccaggccccccgccccctcatctacgacgcctccacccgcgccaccggcgtccccgcccgcttctccggctccggctccggcaccgacttcaccctcaccatctcctccctccagtccgaggacttcgccgtctactactgccagcagtacgacaactggcccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15406 - RNA, 756 nt, synthetic construct
  misc_feature 1..756: note = derived and/or modified sequence opt2 from Brolucizumab_HeavyChain1
  source 1..756: mol_type = other RNA
atggagatcgtcatgacccagtccccctccaccctctccgcctccgtcggcgaccgcgtcatcatcacctgccaggcctccgagatcatccactcctggctcgcctggtaccagcagaagcccggcaaggcccccaagctcctcatctacctcgcctccaccctcgcctccggcgtcccctcccgcttctccggctccggctccggcgccgagttcaccctcaccatctcctccctccagcccgacgacttcgccacctactactgccagaacgtctacctcgcctccaccaacggcgccaacttcggccagggcaccaagctcaccgtcctcggcggcggcggcggctccggcggcggcggctccggcggcggcggctccggcggcggcggctccgaggtccagctcgtcgagtccggcggcggcctcgtccagcccggcggctccctccgcctctcctgcaccgcctccggcttctccctcaccgactactactacatgacctgggtccgccaggcccccggcaagggcctcgagtgggtcggcttcatcgaccccgacgacgacccctactacgccacctgggccaagggccgcttcaccatctcccgcgacaactccaagaacaccctctacctccagatgaactccctccgcgccgaggacaccgccgtctactactgcgccggcggcgaccacaactccggctggggcctcgacatctggggccagggcaccctcgtcaccgtctcctcc

SEQ ID NO: 15407 - RNA, 756 nt, synthetic construct; identical to SEQ ID NO: 15406
  misc_feature 1..756: note = derived and/or modified sequence opt2 from Brolucizumab_scFv_fragment
  source 1..756: mol_type = other RNA

SEQ ID NO: 15408 - RNA, 1341 nt, synthetic construct
  misc_feature 1..1341: note = derived and/or modified sequence opt2 from Brontictuzumab_HeavyChain1
  source 1..1341: mol_type = other RNA
caggtccagctcgtccagtccggcgccgaggtcaagaagcccggcgcctccgtcaagatctcctgcaaggtctccggctacaccctccgcggctactggatcgagtgggtccgccaggcccccggcaagggcctcgagtggatcggccagatcctccccggcaccggccgcaccaactacaacgagaagttcaagggccgcgtcaccatgaccgccgacacctccaccgacaccgcctacatggagctctcctccctccgctccgaggacaccgccgtctactactgcgcccgcttcgacggcaactacggctactacgccatggactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15409 - RNA, 645 nt, synthetic construct
  misc_feature 1..645: note = derived and/or modified sequence opt2 from Brontictuzumab_LightChain1
  source 1..645: mol_type = other RNA
caggccgtcgtcacccaggagccctccctcaccgtctcccccggcggcaccgtcaccctcacctgccgctcctccaccggcgccgtcaccacctccaactacgccaactggttccagcagaagcccggccaggccccccgcaccctcatcggcggcaccaacaaccgcgcccccggcgtccccgcccgcttctccggctccctcctcggcggcaaggccgccctcaccctctccggcgcccagcccgaggacgaggccgagtactactgcgccctctggtactccaaccactgggtcttcggcggcggcaccaagctcaccgtcctcggccagcccaaggccgccccctccgtcaccctcttccccccctcctccgaggagctccaggccaacaaggccaccctcgtctgcctcgtctccgacttctaccccggcgccgtcaccgtcgcctggaaggccgacggctcccccgtcaaggtcggcgtcgagaccaccaagccctccaagcagtccaacaacaagtacgccgcctcctcctacctctccctcacccccgagcagtggaagtcccaccgctcctactcctgccgcgtcacccacgagggctccaccgtcgagaagaccgtcgcccccgccgagtgctcc

SEQ ID NO: 15410 - RNA, 1332 nt, synthetic construct
  misc_feature 1..1332: note = derived and/or modified sequence opt2 from BTT-1023_HeavyChain1
  source 1..1332: mol_type = other RNA
caggtccagctcgtcgagtccggcggcggcgtcgtccagcccggccgctccctccgcctctcctgcgccgcctccggcttcaccttcttctcctacgccatgcactgggtccgccagacccccggcaagggcctcgagtgggtcgccgtcatctggttcgacggctccaacgagaactacgtcgactccgtcaagggccgcttcaccatctcccgcgacaactccaagaacaccctctacctccagatgaacaccctccgcgccgaggacaccgccgtctactactgcgcccgcgacgcctggtcctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcgccggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15411 - RNA, 642 nt, synthetic construct
  misc_feature 1..642: note = derived and/or modified sequence opt2 from BTT-1023_LightChain1
  source 1..642: mol_type = other RNA
gtcatccagctcacccagtccccctcctccctctccgcctccgtcggcgaccgcgtcaccatcacctgccgcgcctcccagggcatctcccgcgccctcgcctggtaccagcagaagcccggcaagggccccaagctcctcatctacgacgcctcctccctcgagtccggcgtcccctcccgcttctccggctccggctccggcaccgacttcaccctcaccatctcctccctccagcccgaggacttcgccacctactactgccagcagttcaactcctaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15412 - RNA, 1341 nt, synthetic construct
  misc_feature 1..1341: note = derived and/or modified sequence opt2 from Burosumab_HeavyChain1
  source 1..1341: mol_type = other RNA
caggtccagctcgtccagtccggcgccgaggtcaagaagcccggcgcctccgtcaaggtctcctgcaaggcctccggctacaccttcaccaaccactacatgcactgggtccgccaggcccccggccagggcctcgagtggatgggcatcatcaaccccatctccggctccacctccaacgcccagaagttccagggccgcgtcaccatgacccgcgacacctccacctccaccgtctacatggagctctcctccctccgctccgaggacaccgccgtctactactgcgcccgcgacatcgtcgacgccttcgacttctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15413 - RNA, 639 nt, synthetic construct
  misc_feature 1..639: note = derived and/or modified sequence opt2 from Burosumab_LightChain1
  source 1..639: mol_type = other RNA
gccatccagctcacccagtccccctcctccctctccgcctccgtcggcgaccgcgtcaccatcacctgccgcgcctcccagggcatctcctccgccctcgtctggtaccagcagaagcccggcaaggcccccaagctcctcatctacgacgcctcctccctcgagtccggcgtcccctcccgcttctccggctccggctccggcaccgacttcaccctcaccatctcctccctccagcccgaggacttcgccacctactactgccagcagttcaacgactacttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15414 - RNA, 1344 nt, synthetic construct
  misc_feature 1..1344: note = derived and/or modified sequence opt2 from Canakinumab_HeavyChain1
  source 1..1344: mol_type = other RNA
caggtccagctcgtcgagtccggcggcggcgtcgtccagcccggccgctccctccgcctctcctgcgccgcctccggcttcaccttctccgtctacggcatgaactgggtccgccaggcccccggcaagggcctcgagtgggtcgccatcatctggtacgacggcgacaaccagtactacgccgactccgtcaagggccgcttcaccatctcccgcgacaactccaagaacaccctctacctccagatgaacggcctccgcgccgaggacaccgccgtctactactgcgcccgcgacctccgcaccggccccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15415 - RNA, 1344 nt, synthetic construct; identical to SEQ ID NO: 15414
  misc_feature 1..1344: note = derived and/or modified sequence opt2 from Canakinumab_HeavyChain
  source 1..1344: mol_type = other RNA

SEQ ID NO: 15416 - RNA, 642 nt, synthetic construct
  misc_feature 1..642: note = derived and/or modified sequence opt2 from Canakinumab_LightChain1
  source 1..642: mol_type = other RNA
gagatcgtcctcacccagtcccccgacttccagtccgtcacccccaaggagaaggtcaccatcacctgccgcgcctcccagtccatcggctcctccctccactggtaccagcagaagcccgaccagtcccccaagctcctcatcaagtacgcctcccagtccttctccggcgtcccctcccgcttctccggctccggctccggcaccgacttcaccctcaccatcaactccctcgaggccgaggacgccgccgcctactactgccaccagtcctcctccctccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15417 - RNA, 642 nt, synthetic construct; identical to SEQ ID NO: 15416
  misc_feature 1..642: note = derived and/or modified sequence opt2 from Canakinumab_LightChain
  source 1..642: mol_type = other RNA

SEQ ID NO: 15418 - RNA, 1182 nt, synthetic construct
  misc_feature 1..1182: note = derived and/or modified sequence opt2 from Canakinumab_LightChain_variant_8836_L
  source 1..1182: mol_type = other RNA
caggtccagctcgtcgagtccggcggcggcgtcgtccagcccggccgctccctccgcctctcctgcgccgcctccggcttcaccttctccgtctacggcatgaactgggtccgccaggcccccggcaagggcctcgagtgggtcgccatcatctggtacgacggcgacaaccagtactacgccgactccgtcaagggccgcttcaccatctcccgcgacaactccaagaacaccctctacctccagatgaacggcctccgcgccgaggacaccgccgtctactactgcgcccgcgacctccgcaccggccccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctcgagatcgtcctcacccagtcccccgacttccagtccgtcacccccaaggagaaggtcaccatcacctgccgcgcctcccagtccatcggctcctccctccactggtaccagcagaagcccgaccagtcccccaagctcctcatcaagtacgcctcccagtccttctccggcgtcccctcccgcttctccggctccggctccggcaccgacttcaccctcaccatcaactccctcgaggccgaggacgccgccgcctactactgccaccagtcctcctccctccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15419 - RNA, 1197 nt, synthetic construct
  misc_feature 1..1197: note = derived and/or modified sequence opt2 from Cantuzumab_HeavyChain1
  source 1..1197: mol_type = other RNA
atcgacaccaccaccggcgagcccacctacgcccagaagttccagggccgcatcgccttctccctcgagacctccgcctccaccgcctacctccagatcaagtccctcaagtccgaggacaccgccacctacttctgcgcccgccgcggcccctacaactggtacttcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15420 - RNA, 1347 nt, synthetic construct
  misc_feature 1..1347: note = derived and/or modified sequence opt2 from Cantuzumab_HeavyChain
  source 1..1347: mol_type = other RNA
caggtccagctcgtccagtccggcgccgaggtcaagaagcccggcgagaccgtcaagatctcctgcaaggcctccgactacaccttcacctactacggcatgaactgggtcaagcaggcccccggccagggcctcaagtggatgggctggatcgacaccaccaccggcgagcccacctacgcccagaagttccagggccgcatcgccttctccctcgagacctccgcctccaccgcctacctccagatcaagtccctcaagtccgaggacaccgccacctacttctgcgcccgccgcggcccctacaactggtacttcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15421 - RNA, 657 nt, synthetic construct
  misc_feature 1..657: note = derived and/or modified sequence opt2 from Cantuzumab_LightChain1
  source 1..657: mol_type = other RNA
gacatcgtcatgacccagtcccccctctccgtccccgtcacccccggcgagcccgtctccatctcctgccgctcctccaagtccctcctccactccaacggcaacacctacctctactggttcctccagcgccccggccagtccccccagctcctcatctaccgcatgtccaacctcgtctccggcgtccccgaccgcttctccggctccggctccggcaccgccttcaccctccgcatctcccgcgtcgaggccgaggacgtcggcgtctactactgcctccagcacctcgagtaccccttcaccttcggccccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15422 - RNA, 1344 nt, synthetic construct
  misc_feature 1..1344: note = derived and/or modified sequence opt2 from Cantuzumab_mertansine_HeavyChain1
  source 1..1344: mol_type = other RNA
gtccagctcgtccagtccggcgccgaggtcaagaagcccggcgagaccgtcaagatctcctgcaaggcctccgactacaccttcacctactacggcatgaactgggtcaagcaggcccccggccagggcctcaagtggatgggctggatcgacaccaccaccggcgagcccacctacgcccagaagttccagggccgcatcgccttctccctcgagacctccgcctccaccgcctacctccagatcaagtccctcaagtccgaggacaccgccacctacttctgcgcccgccgcggcccctacaactggtacttcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15423 - RNA, 657 nt, synthetic construct; identical to SEQ ID NO: 15421
  misc_feature 1..657: note = derived and/or modified sequence opt2 from Cantuzumab_mertansine_LightChain1
  source 1..657: mol_type = other RNA

SEQ ID NO: 15424 - RNA, 1347 nt, synthetic construct; identical to SEQ ID NO: 15420
  misc_feature 1..1347: note = derived and/or modified sequence opt2 from Cantuzumab_ravtansine_HeavyChain1
  source 1..1347: mol_type = other RNA

SEQ ID NO: 15425 - RNA, 657 nt, synthetic construct; identical to SEQ ID NO: 15421
  misc_feature 1..657: note = derived and/or modified sequence opt2 from Cantuzumab_ravtansine_LightChain1
  source 1..657: mol_type = other RNA

SEQ ID NO: 15426 - RNA, 777 nt, synthetic construct
  misc_feature 1..777: note = derived and/or modified sequence opt2 from Caplacizumab
  source 1..777: mol_type = other RNA
gaggtccagctcgtcgagtccggcggcggcctcgtccagcccggcggctccctccgcctctcctgcgccgcctccggccgcaccttctcctacaaccccatgggctggttccgccaggcccccggcaagggccgcgagctcgtcgccgccatctcccgcaccggcggctccacctactaccccgactccgtcgagggccgcttcaccatctcccgcgacaacgccaagcgcatggtctacctccagatgaactccctccgcgccgaggacaccgccgtctactactgcgccgccgccggcgtccgcgccgaggacggccgcgtccgcaccctcccctccgagtacaccttctggggccagggcacccaggtcaccgtctcctccgccgccgccgaggtccagctcgtcgagtccggcggcggcctcgtccagcccggcggctccctccgcctctcctgcgccgcctccggccgcaccttctcctacaaccccatgggctggttccgccaggcccccggcaagggccgcgagctcgtcgccgccatctcccgcaccggcggctccacctactaccccgactccgtcgagggccgcttcaccatctcccgcgacaacgccaagcgcatggtctacctccagatgaactccctccgcgccgaggacaccgccgtctactactgcgccgccgccggcgtccgcgccgaggacggccgcgtccgcaccctcccctccgagtacaccttctggggccagggcacccaggtcaccgtctcctcc

SEQ ID NO: 15427 - RNA, 777 nt, synthetic construct; identical to SEQ ID NO: 15426
  misc_feature 1..777: note = derived and/or modified sequence opt2 from Caplacizumab_HeavyChain1
  source 1..777: mol_type = other RNA

SEQ ID NO: 15428 - RNA, 777 nt, synthetic construct; identical to SEQ ID NO: 15426
  misc_feature 1..777: note = derived and/or modified sequence opt2 from Caplacizumab_HeavyChain1
  source 1..777: mol_type = other RNA

SEQ ID NO: 15429 - RNA, 1347 nt, synthetic construct
  misc_feature 1..1347: note = derived and/or modified sequence opt2 from Carlumab_HeavyChain1
  source 1..1347: mol_type = other RNA
caggtccagctcgtccagtccggcgccgaggtcaagaagcccggctcctccgtcaaggtctcctgcaaggcctccggcggcaccttctcctcctacggcatctcctgggtccgccaggcccccggccagggcctcgagtggatgggcggcatcatccccatcttcggcaccgccaactacgcccagaagttccagggccgcgtcaccatcaccgccgacgagtccacctccaccgcctacatggagctctcctccctccgctccgaggacaccgccgtctactactgcgcccgctacgacggcatctacggcgagctcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15430 - RNA, 648 nt, synthetic construct
  misc_feature 1..648: note = derived and/or modified sequence opt2 from Carlumab_LightChain1
  source 1..648: mol_type = other RNA
gagatcgtcctcacccagtcccccgccaccctctccctctcccccggcgagcgcgccaccctctcctgccgcgcctcccagtccgtctccgacgcctacctcgcctggtaccagcagaagcccggccaggccccccgcctcctcatctacgacgcctcctcccgcgccaccggcgtccccgcccgcttctccggctccggctccggcaccgacttcaccctcaccatctcctccctcgagcccgaggacttcgccgtctactactgccaccagtacatccagctccactccttcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15431 - RNA, 1353 nt, synthetic construct
  misc_feature 1..1353: note = derived and/or modified sequence opt2 from Cergutuzumab_amunaleukin_HeavyChain1
  source 1..1353: mol_type = other RNA
caggtccagctcgtccagtccggcgccgaggtcaagaagcccggcgcctccgtcaaggtctcctgcaaggcctccggctacaccttcaccgagttcggcatgaactgggtccgccaggcccccggccagggcctcgagtggatgggctggatcaacaccaagaccggcgaggccacctacgtcgaggagttcaagggccgcgtcaccttcaccaccgacacctccacctccaccgcctacatggagctccgctccctccgctccgacgacaccgccgtctactactgcgcccgctgggacttcgcctactacgtcgaggccatggactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctcggcgcccccatcgagaagaccatctccaaggccaagggccagccccgcgagccccaggtctgcaccctccccccctcccgcgacgagctcaccaagaaccaggtctccctctcctgcgccgtcaagggcttctacccctccgacatcgccgtcgagtgggagtccaacggccagcccgagaacaactacaagaccaccccccccgtcctcgactccgacggctccttcttcctcgtctccaagctcaccgtcgacaagtcccgctggcagcagggcaacgtcttctcctgctccgtcatgcacgaggccctccacaaccactacacccagaagtccctctccctctcccccggcaag

SEQ ID NO: 15432 - RNA, 1794 nt, synthetic construct
  misc_feature 1..1794: note = derived and/or modified sequence opt2 from Cergutuzumab_amunaleukin_HeavyChain2
  source 1..1794: mol_type = other RNA
caggtccagctcgtccagtccggcgccgaggtcaagaagcccggcgcctccgtcaaggtctcctgcaaggcctccggctacaccttcaccgagttcggcatgaactgggtccgccaggcccccggccagggcctcgagtggatgggctggatcaacaccaagaccggcgaggccacctacgtcgaggagttcaagggccgcgtcaccttcaccaccgacacctccacctccaccgcctacatggagctccgctccctccgctccgacgacaccgccgtctactactgcgcccgctgggacttcgcctactacgtcgaggccatggactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctcggcgcccccatcgagaagaccatctccaaggccaagggccagccccgcgagccccaggtctacaccctccccccctgccgcgacgagctcaccaagaaccaggtctccctctggtgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcggcggcggcggctccggcggcggcggctccggcggcggcggctccgcccccgcctcctcctccaccaagaagacccagctccagctcgagcacctcctcctcgacctccagatgatcctcaacggcatcaacaactacaagaaccccaagctcacccgcatgctcaccgccaagttcgccatgcccaagaaggccaccgagctcaagcacctccagtgcctcgaggaggagctcaagcccctcgaggaggtcctcaacggcgcccagtccaagaacttccacctccgcccccgcgacctcatctccaacatcaacgtcatcgtcctcgagctcaagggctccgagaccaccttcatgtgcgagtacgccgacgagaccgccaccatcgtcgagttcctcaaccgctggatcaccttcgcccagtccatcatctccaccctcacc

SEQ ID NO: 15433 - RNA, 645 nt, synthetic construct
  misc_feature 1..645: note = derived and/or modified sequence opt2 from Cergutuzumab_amunaleukin_LightChain1
  source 1..645: mol_type = other RNA
gacatccagatgacccagtccccctcctccctctccgcctccgtcggcgaccgcgtcaccatcacctgcaaggcctccgccgccgtcggcacctacgtcgcctggtaccagcagaagcccggcaaggcccccaagctcctcatctactccgcctcctaccgcaagcgcggcgtcccctcccgcttctccggctccggctccggcaccgacttcaccctcaccatctcctccctccagcccgaggacttcgccacctactactgccaccagtactacacctaccccctcttcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15434 - RNA, 687 nt, synthetic construct
  misc_feature 1..687: note = derived and/or modified sequence opt2 from Certolizumab_pegol_HeavyChain1
  source 1..687: mol_type = other RNA
gaggtccagctcgtcgagtccggcggcggcctcgtccagcccggcggctccctccgcctctcctgcgccgcctccggctacgtcttcaccgactacggcatgaactgggtccgccaggcccccggcaagggcctcgagtggatgggctggatcaacacctacatcggcgagcccatctacgccgactccgtcaagggccgcttcaccttctccctcgacacctccaagtccaccgcctacctccagatgaactccctccgcgccgaggacaccgccgtctactactgcgcccgcggctaccgctcctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgcgccgcc

SEQ ID NO: 15435 - RNA, 687 nt, synthetic construct; identical to SEQ ID NO: 15434
  misc_feature 1..687: note = derived and/or modified sequence opt2 from Certolizumab_pegol_HeavyChain
  source 1..687: mol_type = other RNA

SEQ ID NO: 15436 - RNA, 642 nt, synthetic construct
  misc_feature 1..642: note = derived and/or modified sequence opt2 from Certolizumab_pegol_LightChain1
  source 1..642: mol_type = other RNA
gacatccagatgacccagtccccctcctccctctccgcctccgtcggcgaccgcgtcaccatcacctgcaaggcctcccagaacgtcggcaccaacgtcgcctggtaccagcagaagcccggcaaggcccccaaggccctcatctactccgcctccttcctctactccggcgtcccctaccgcttctccggctccggctccggcaccgacttcaccctcaccatctcctccctccagcccgaggacttcgccacctactactgccagcagtacaacatctaccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15437 - RNA, 642 nt, synthetic construct; identical to SEQ ID NO: 15436
  misc_feature 1..642: note = derived and/or modified sequence opt2 from Certolizumab_pegol_LightChain
  source 1..642: mol_type = other RNA

SEQ ID NO: 15438 - RNA, 1356 nt, synthetic construct
  misc_feature 1..1356: note = derived and/or modified sequence opt2 from Cetuximab_HeavyChain
  source 1..1356: mol_type = other RNA
caggtccagctcaagcagtccggccccggcctcgtccagccctcccagtccctctccatcacctgcaccgtctccggcttctccctcaccaactacggcgtccactgggtccgccagtcccccggcaagggcctcgagtggctcggcgtcatctggtccggcggcaacaccgactacaacacccccttcacctcccgcctctccatcaacaaggacaactccaagtcccaggtcttcttcaagatgaactccctccagtccaacgacaccgccatctactactgcgcccgcgccctcacctactacgactacgagttcgcctactggggccagggcaccctcgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15439 - RNA, 1347 nt, synthetic construct
  misc_feature 1..1347: note = derived and/or modified sequence opt2 from Cetuximab_HeavyChain_variant
  source 1..1347: mol_type = other RNA
caggtccagctcaagcagtccggccccggcctcgtccagccctcccagtccctctccatcacctgcaccgtctccggcttctccctcaccaactacggcgtccactgggtccgccagtcccccggcaagggcctcgagtggctcggcgtcatctggtccggcggcaacaccgactacaacacccccttcacctcccgcctctccatcaacaaggacaactccaagtcccaggtcttcttcaagatgaactccctccagtccaacgacaccgccatctactactgcgcccgcgccctcacctactacgactacgagttcgcctactggggccagggcaccctcgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15440 - RNA, 639 nt, synthetic construct
  misc_feature 1..639: note = derived and/or modified sequence opt2 from Cetuximab_LightChain
  source 1..639: mol_type = other RNA
gacatcctcctcacccagtcccccgtcatcctctccgtctcccccggcgagcgcgtctccttctcctgccgcgcctcccagtccatcggcaccaacatccactggtaccagcagcgcaccaacggctccccccgcctcctcatcaagtacgcctccgagtccatctccggcatcccctcccgcttctccggctccggctccggcaccgacttcaccctctccatcaactccgtcgagtccgaggacatcgccgactactactgccagcagaacaacaactggcccaccaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgcc

SEQ ID NO: 15441 - RNA, 642 nt, synthetic construct
  misc_feature 1..642: note = derived and/or modified sequence opt2 from Cetuximab_LightChain_variant
  source 1..642: mol_type = other RNA
gacatcctcctcacccagtcccccgtcatcctctccgtctcccccggcgagcgcgtctccttctcctgccgcgcctcccagtccatcggcaccaacatccactggtaccagcagcgcaccaacggctccccccgcctcctcatcaagtacgcctccgagtccatctccggcatcccctcccgcttctccggctccggctccggcaccgacttcaccctctccatcaactccgtcgagtccgaggacatcgccgactactactgccagcagaacaacaactggcccaccaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15442 - RNA, 675 nt, synthetic construct
  misc_feature 1..675: note = derived and/or modified sequence opt2 from Citatuzumab_bogatox_HeavyChain1
  source 1..675: mol_type = other RNA
caccaccaccaccaccacgaggtccagctcgtccagtccggccccggcctcgtccagcccggcggctccgtccgcatctcctgcgccgcctccggctacaccttcaccaactacggcatgaactgggtcaagcaggcccccggcaagggcctcgagtggatgggctggatcaacacctacaccggcgagtccacctacgccgactccttcaagggccgcttcaccttctccctcgacacctccgcctccgccgcctacctccagatcaactccctccgcgccgaggacaccgccgtctactactgcgcccgcttcgccatcaagggcgactactggggccagggcaccctcctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 15443 - RNA, 1443 nt, synthetic construct
  misc_feature 1..1443: note = derived and/or modified sequence opt2 from Citatuzumab_bogatox_LightChain1
  source 1..1443: mol_type = other RNA
gacatccagatgacccagtccccctcctccctctccgcctccgtcggcgaccgcgtcaccatcacctgccgctccaccaagtccctcctccactccaacggcatcacctacctctactggtaccagcagaagcccggcaaggcccccaagctcctcatctaccagatgtccaacctcgcctccggcgtcccctcccgcttctcctcctccggctccggcaccgacttcaccctcaccatctcctccctccagcccgaggacttcgccacctactactgcgcccagaacctcgagatcccccgcaccttcggccagggcaccaaggtcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgcacccgccaccgccagccccgcggctgggagcagctctacaacaccgtctccttcaacctcggcgaggcctacgagtaccccaccttcatccaggacctccgcaacgagctcgccaagggcacccccgtctgccagctccccgtcaccctccagaccatcgccgacgacaagcgcttcgtcctcgtcgacatcaccaccacctccaagaagaccgtcaaggtcgccatcgacgtcaccgacgtctacgtcgtcggctaccaggacaagtgggacggcaaggaccgcgccgtcttcctcgacaaggtccccaccgtcgccacctccaagctcttccccggcgtcaccaaccgcgtcaccctcaccttcgacggctcctaccagaagctcgtcaacgccgccaaggccgaccgcaaggccctcgagctcggcgtcaacaagctcgagttctccatcgaggccatccacggcaagaccatcaacggccaggaggccgccaagttcttcctcatcgtcatccagatggtctccgaggccgcccgcttcaagtacatcgagaccgaggtcgtcgaccgcggcctctacggctccttcaagcccaacttcaaggtcctcaacctcgagaacaactggggcgacatctccgacgccatccacaagtcctccccccagtgcaccaccatcaaccccgccctccagctcatctccccctccaacgacccctgggtcgtcaacaaggtctcccagatctcccccgacatgggcatcctcaagttcaagtcctccaag

SEQ ID NO: 15444 - RNA, 1380 nt, synthetic construct
  misc_feature 1..1380: note = derived and/or modified sequence opt2 from Cixutumumab_HeavyChain1
  source 1..1380: mol_type = other RNA
gaggtccagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatccccatcttcggcaccgccaactacgcccagaagttccagggccgcgtcaccatcaccgccgacaagtccacctccaccgcctacatggagctctcctccctccgctccgaggacaccgccgtctactactgcgcccgcgcccccctccgcttcctcgagtggtccacccaggaccactactactactactacatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15445 - RNA, 642 nt, synthetic construct
  misc_feature 1..642: note = derived and/or modified sequence opt2 from Cixutumumab_LightChain1
  source 1..642: mol_type = other RNA
tcctccgagctcacccaggaccccgccgtctccgtcgccctcggccagaccgtccgcatcacctgccagggcgactccctccgctcctactacgccacctggtaccagcagaagcccggccaggcccccatcctcgtcatctacggcgagaacaagcgcccctccggcatccccgaccgcttctccggctcctcctccggcaacaccgcctccctcaccatcaccggcgcccaggccgaggacgaggccgactactactgcaagtcccgcgacggctccggccagcacctcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccgccgagtgctcc

SEQ ID NO: 15446 - RNA, 1350 nt, synthetic construct
  misc_feature 1..1350: note = derived and/or modified sequence opt2 from Clazakizumab_HeavyChain1
  source 1..1350: mol_type = other RNA
gaggtccagctcgtcgagtccggcggcggcctcgtccagcccggcggctccctccgcctctcctgcgccgcctccggcttctccctctccaactactacgtcacctgggtccgccaggcccccggcaagggcctcgagtgggtcggcatcatctacggctccgacgagaccgcctacgccacctccgccatcggccgcttcaccatctcccgcgacaactccaagaacaccctctacctccagatgaactccctccgcgccgaggacaccgccgtctactactgcgcccgcgacgactcctccgactgggacgccaagttcaacctctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15447 - RNA, 651 nt, synthetic construct
  misc_feature 1..651: note = derived and/or modified sequence opt2 from Clazakizumab_LightChain1
  source 1..651: mol_type = other RNA
gccatccagatgacccagtccccctcctccctctccgcctccgtcggcgaccgcgtcaccatcacctgccaggcctcccagtccatcaacaacgagctctcctggtaccagcagaagcccggcaaggcccccaagctcctcatctaccgcgcctccaccctcgcctccggcgtcccctcccgcttctccggctccggctccggcaccgacttcaccctcaccatctcctccctccagcccgacgacttcgccacctactactgccagcagggctactccctccgcaacatcgacaacgccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15448 - RNA, 1347 nt, synthetic construct
  misc_feature 1..1347: note = derived and/or modified sequence opt2 from Clivatuzumab_tetraxetan_HeavyChain1
  source 1..1347: mol_type = other RNA
caggtccagctccagcagtccggcgccgaggtcaagaagcccggcgcctccgtcaaggtctcctgcgaggcctccggctacaccttcccctcctacgtcctccactgggtcaagcaggcccccggccagggcctcgagtggatcggctacatcaacccctacaacgacggcacccagtacaacgagaagttcaagggcaaggccaccctcacccgcgacacctccatcaacaccgcctacatggagctctcccgcctccgctccgacgacaccgccgtctactactgcgcccgcggcttcggcggctcctacggcttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15449 - RNA, 645 nt, synthetic construct
  misc_feature 1..645: note = derived and/or modified sequence opt2 from Clivatuzumab_tetraxetan_LightChain1
  source 1..645: mol_type = other RNA
gacatccagctcacccagtccccctcctccctctccgcctccgtcggcgaccgcgtcaccatgacctgctccgcctcctcctccgtctcctcctcctacctctactggtaccagcagaagcccggcaaggcccccaagctctggatctactccacctccaacctcgcctccggcgtccccgcccgcttctccggctccggctccggcaccgacttcaccctcaccatctcctccctccagcccgaggactccgcctcctacttctgccaccagtggaaccgctacccctacaccttcggcggcggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15450 - RNA, 1335 nt, synthetic construct
  misc_feature 1..1335: note = derived and/or modified sequence opt2 from Codrituzumab_HeavyChain1
  source 1..1335: mol_type = other RNA
caggtccagctcgtccagtccggcgccgaggtcaagaagcccggcgcctccgtcaaggtctcctgcaaggcctccggctacaccttcaccgactacgagatgcactgggtccgccaggcccccggccagggcctcgagtggatgggcgccctcgaccccaagaccggcgacaccgcctactcccagaagttcaagggccgcgtcaccctcaccgccgacaagtccacctccaccgcctacatggagctctcctccctcacctccgaggacaccgccgtctactactgcacccgcttctactcctacacctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15451 - RNA, 657 nt, synthetic construct
  misc_feature 1..657: note = derived and/or modified sequence opt2 from Codrituzumab_LightChain1
  source 1..657: mol_type = other RNA
gacgtcgtcatgacccagtcccccctctccctccccgtcacccccggcgagcccgcctccatctcctgccgctcctcccagtccctcgtccactccaaccgcaacacctacctccactggtacctccagaagcccggccagtccccccagctcctcatctacaaggtctccaaccgcttctccggcgtccccgaccgcttctccggctccggctccggcaccgacttcaccctcaagatctcccgcgtcgaggccgaggacgtcggcgtctactactgctcccagaacacccacgtcccccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15452 - RNA, 1350 nt, synthetic construct
  misc_feature 1..1350: note = derived and/or modified sequence opt2 from Coltuximab_ravtansine_HeavyChain1
  source 1..1350: mol_type = other RNA
caggtccagctcgtccagcccggcgccgaggtcgtcaagcccggcgcctccgtcaagctctcctgcaagacctccggctacaccttcacctccaactggatgcactgggtcaagcaggcccccggccagggcctcgagtggatcggcgagatcgacccctccgactcctacaccaactacaaccagaacttccagggcaaggccaagctcaccgtcgacaagtccacctccaccgcctacatggaggtctcctccctccgctccgacgacaccgccgtctactactgcgcccgcggctccaacccctactactacgccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15453 - RNA, 633 nt, synthetic construct
  misc_feature 1..633: note = derived and/or modified sequence opt2 from Coltuximab_ravtansine_LightChain1
  source 1..633: mol_type = other RNA
gagatcgtcctcacccagtcccccgccatcatgtccgcctcccccggcgagcgcgtcaccatgacctgctccgcctcctccggcgtcaactacatgcactggtaccagcagaagcccggcacctccccccgccgctggatctacgacacctccaagctcgcctccggcgtccccgcccgcttctccggctccggctccggcaccgactactccctcaccatctcctccatggagcccgaggacgccgccacctactactgccaccagcgcggctcctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15454 - RNA, 1356 nt, synthetic construct
  misc_feature 1..1356: note = derived and/or modified sequence opt2 from Conatumumab_CV_HeavyChain
  source 1..1356: mol_type = other RNA
caggtccagctccaggagtccggccccggcctcgtcaagccctcccagaccctctccctcacctgcaccgtctccggcggctccatctcctccggcgactacttctggtcctggatccgccagctccccggcaagggcctcgagtggatcggccacatccacaactccggcaccacctactacaacccctccctcaagtcccgcgtcaccatctccgtcgacacctccaagaagcagttctccctccgcctctcctccgtcaccgccgccgacaccgccgtctactactgcgcccgcgaccgcggcggcgactactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15455 - RNA, 645 nt, synthetic construct
  misc_feature 1..645: note = derived and/or modified sequence opt2 from Conatumumab_CV_LightChain
  source 1..645: mol_type = other RNA
gagatcgtcctcacccagtcccccggcaccctctccctctcccccggcgagcgcgccaccctctcctgccgcgcctcccagggcatctcccgctcctacctcgcctggtaccagcagaagcccggccaggccccctccctcctcatctacggcgcctcctcccgcgccaccggcatccccgaccgcttctccggctccggctccggcaccgacttcaccctcaccatctcccgcctcgagcccgaggacttcgccgtctactactgccagcagttcggctcctccccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15456 - RNA, 1356 nt, synthetic construct; identical to SEQ ID NO: 15454
  misc_feature 1..1356: note = derived and/or modified sequence opt2 from Conatumumab_HeavyChain1
  source 1..1356: mol_type = other RNA

SEQ ID NO: 15457 - RNA, 1356 nt, synthetic construct; identical to SEQ ID NO: 15454
  misc_feature 1..1356: note = derived and/or modified sequence opt2 from Conatumumab_HeavyChain
  source 1..1356: mol_type = other RNA

SEQ ID NO: 15458 - RNA, 645 nt, synthetic construct; identical to SEQ ID NO: 15455
  misc_feature 1..645: note = derived and/or modified sequence opt2 from Conatumumab_LightChain1
  source 1..645: mol_type = other RNA

SEQ ID NO: 15459 - RNA, 645 nt, synthetic construct; identical to SEQ ID NO: 15455
  misc_feature 1..645: note = derived and/or modified sequence opt2 from Conatumumab_LightChain
  source 1..645: mol_type = other RNA

SEQ ID NO: 15460 - RNA, 1344 nt, synthetic construct
  misc_feature 1..1344: note = derived and/or modified sequence opt2 from Concizumab_HeavyChain1
  source 1..1344: mol_type = other RNA
gaggtccagctcgtcgagtccggcggcggcctcgtcaagcccggcggctccctccgcctctcctgcgccgcctccggcttcaccttctccaactacgccatgtcctgggtccgccagacccccgagaagcgcctcgagtgggtcgccaccatctcccgctccggctcctactcctacttccccgactccgtccagggccgcttcaccatctcccgcgacaacgccaagaactccctctacctccagatgaactccctccgcgccgaggacaccgccgtctactactgcgcccgcctcggcggctacgacgagggcgacgccatggactcctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15461 - RNA, 657 nt, synthetic construct
  misc_feature 1..657: note = derived and/or modified sequence opt2 from Concizumab_LightChain1
  source 1..657: mol_type = other RNA
gacatcgtcatgacccagacccccctctccctctccgtcacccccggccagcccgcctccatctcctgcaagtcctcccagtccctcctcgagtccgacggcaagacctacctcaactggtacctccagaagcccggccagtccccccagctcctcatctacctcgtctccatcctcgactccggcgtccccgaccgcttctccggctccggctccggcaccgacttcaccctcaagatctcccgcgtcgaggccgaggacgtcggcgtctactactgcctccaggccacccacttcccccagaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15462 - RNA, 1314 nt, synthetic construct
  misc_feature 1..1314: note = derived and/or modified sequence opt2 from Crenezumab_HeavyChain1
  source 1..1314: mol_type = other RNA
gaggtccagctcgtcgagtccggcggcggcctcgtccagcccggcggctccctccgcctctcctgcgccgcctccggcttcaccttctcctcctacggcatgtcctgggtccgccaggcccccggcaagggcctcgagctcgtcgcctccatcaactccaacggcggctccacctactaccccgactccgtcaagggccgcttcaccatctcccgcgacaacgccaagaactccctctacctccagatgaactccctccgcgccgaggacaccgccgtctactactgcgcctccggcgactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15463 - RNA, 657 nt, synthetic construct
  misc_feature 1..657: note = derived and/or modified sequence opt2 from Crenezumab_LightChain1
  source 1..657: mol_type = other RNA
gacatcgtcatgacccagtcccccctctccctccccgtcacccccggcgagcccgcctccatctcctgccgctcctcccagtccctcgtctactccaacggcgacacctacctccactggtacctccagaagcccggccagtccccccagctcctcatctacaaggtctccaaccgcttctccggcgtccccgaccgcttctccggctccggctccggcaccgacttcaccctcaagatctcccgcgtcgaggccgaggacgtcggcgtctactactgctcccagtccacccacgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15464 - RNA, 1365 nt, synthetic construct
  misc_feature 1..1365: note = derived and/or modified sequence opt2 from Crotedumab_HeavyChain1
  source 1..1365: mol_type = other RNA
gaggtccagctcgtcgagtccggcggcggcctcgtccagcccggcggctccctccgcctctcctgcgccgcctccggcttcaccttctccaactacctcatgaactgggtccgccaggcccccggcaagggcctcgagtggctcgccaacatccaggaggacggcatcgagaagtactacgtcgactccgtcaagggccgcttcaccatctcccgcgacaacgccaagaactccctctacctccagatgaactccctccgcgccgaggacaccgccgtctactactgcgcccgcgagccctcccactacgacatcctcaccggctacgactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctccaacaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15465 - RNA, 1365 nt, synthetic construct
  misc_feature 1..1365: note = derived and/or modified sequence opt2 from Crotedumab_HeavyChain2
  source 1..1365: mol_type = other RNA
gaggtccagctcgtcgagtccggcggcggcctcgtccagcccggcggctccctccacctctcctgcgccgcctccggcttcaccttctccaactacctcatgaactgggtccgccaggcccccggcaagggcctcgagtggctcgccaacatccaggaggacggcatcgagaagtactacgtcgactccgtcaagggccgcttcaccatctcccgcgacaacgccaagaactccctctacctccagatgaactccctccgcgccgaggacaccgccgtctactactgcgcccgcgagccctcccactacgacatcctcaccggctacgactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctccaacaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccgaggtcgacgagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttctggtccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacgagtcccgctggcaggagcacaacgtcttctcctgctccgtcatgcacgaggccctccacaaccactacacccagaagtccctctccctctccctcggcaag

SEQ ID NO: 15466 - RNA, 642 nt, synthetic construct
  misc_feature 1..642: note = derived and/or modified sequence opt2 from Crotedumab_LightChain1
  source 1..642: mol_type = other RNA
gacatccagatgacccagtccccctcctccctctccgcctccgtcggcgaccgcgtcaccatcacctgccgcgcctcccagggcatccgcaacgacctcggctggtaccagcagaagcccggcaaggcccccaagcgcctcatctacgccgcctcctccctccagtccggcgtcccctcccgcttctccggctccggctccggcaccgagttcatcctcaccgtctcctccctccagcccgaggacttcgccacctactactgcctccagtacaacgagaaccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgaggagcacaaggtctacgcctgcgaggtcacccaccagggcctctcctcccccgtcaccaagtccttcaaccgcggcgagtgc

SEQ ID NO: 15467 - RNA, 642 nt, synthetic construct
  misc_feature 1..642: note = derived and/or modified sequence opt2 from Crotedumab_LightChain2
  source 1..642: mol_type = other RNA
gacatccagatgacccagtccccctcctccctctccgcctccgtcggcgaccgcgtcaccatcacctgccgcgcctcccagggcatccgcaacgacctcggctggtaccagcagaagcccggcaaggcccccaagcgcctcatctacgccgcctcctccctccagtccggcgtcccctcccgcttctccggctccggctccggcaccgagttcatcctcaccgtctcctccctccagcccgaggacttcgccacctactactgcctccagtacaactccaaccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagaacaaggtcgacaacgccctccagtccggcaactcccaggagtccgtcaccgagcaggactccaaggactccacctactccctctcctccaccctcaccctctccgaggccgactacgagaagcacaaggtctacgcctgcgaggtcacccaccagggcctctcctcccccgtcaccaagtccttcaaccgcggcgagtgc

SEQ ID NO: 15468 - RNA, 1332 nt, synthetic construct
  misc_feature 1..1332: note = derived and/or modified sequence opt2 from Dacetuzumab_HeavyChain1
  source 1..1332: mol_type = other RNA
gaggtccagctcgtcgagtccggcggcggcctcgtccagcccggcggctccctccgcctctcctgcgccgcctccggctactccttcaccggctactacatccactgggtccgccaggcccccggcaagggcctcgagtgggtcgcccgcgtcatccccaacgccggcggcacctcctacaaccagaagttcaagggccgcttcaccctctccgtcgacaactccaagaacaccgcctacctccagatgaactccctccgcgccgaggacaccgccgtctactactgcgcccgcgagggcatctactggtggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15469 - RNA, 657 nt, synthetic construct
  misc_feature 1..657: note = derived and/or modified sequence opt2 from Dacetuzumab_LightChain1
  source 1..657: mol_type = other RNA
gacatccagatgacccagtccccctcctccctctccgcctccgtcggcgaccgcgtcaccatcacctgccgctcctcccagtccctcgtccactccaacggcaacaccttcctccactggtaccagcagaagcccggcaaggcccccaagctcctcatctacaccgtctccaaccgcttctccggcgtcccctcccgcttctccggctccggctccggcaccgacttcaccctcaccatctcctccctccagcccgaggacttcgccacctacttctgctcccagaccacccacgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15470 - RNA, 318 nt, synthetic construct
  misc_feature 1..318: note = derived and/or modified sequence opt2 from Dacliximab_LightChain_VJ-Region
  source 1..318: mol_type = other RNA
gacatccagatgacccagtccccctccaccctctccgcctccgtcggcgaccgcgtcaccatcacctgctccgcctcctcctccatctcctacatgcactggtaccagcagaagcccggcaaggcccccaagctcctcatctacaccacctccaacctcgcctccggcgtccccgcccgcttctccggctccggctccggcaccgagttcaccctcaccatctcctccctccagcccgacgacttcgccacctactactgccaccagcgctccacctaccccctcaccttcggccagggcaccaaggtcgaggtcaag

SEQ ID NO: 15471 - RNA, 348 nt, synthetic construct
  misc_feature 1..348: note = derived and/or modified sequence opt2 from Dacliximab_gamma2-Chain_VDJ-Region
  source 1..348: mol_type = other RNA
caggtccagctcgtccagtccggcgccgaggtcaagaagcccggctcctccgtcaaggtctcctgcaaggcctccggctacaccttcacctcctaccgcatgcactgggtccgccaggcccccggccagggcctcgagtggatcggctacatcaacccctccaccggctacaccgagtacaaccagaagttcaaggacaaggccaccatcaccgccgacgagtccaccaacaccgcctacatggagctctcctccctccgctccgaggacaccgccgtctactactgcgcccgcggcggcggcgtcttcgactactggggccagggcaccctcgtcaccgtctcctcc

SEQ ID NO: 15472 - RNA, 1326 nt, synthetic construct
  misc_feature 1..1326: note = derived and/or modified sequence opt2 from Daclizumab_HeavyChain
  source 1..1326: mol_type = other RNA
caggtccagctcgtccagtccggcgccgaggtcaagaagcccggctcctccgtcaaggtctcctgcaaggcctccggctacaccttcacctcctaccgcatgcactgggtccgccaggcccccggccagggcctcgagtggatcggctacatcaacccctccaccggctacaccgagtacaaccagaagttcaaggacaaggccaccatcaccgccgacgagtccaccaacaccgcctacatggagctctcctccctccgctccgaggacaccgccgtctactactgcgcccgcggcggcggcgtcttcgactactggggccagggcaccaccctcaccgtctcctccggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15473 - RNA, 630 nt, synthetic construct
  misc_feature 1..630: note = derived and/or modified sequence opt2 from Daclizumab_LightChain
  source 1..630: mol_type = other RNA
gacatccagatgacccagtccccctccaccctctccgcctccgtcggcgaccgcgtcaccatcacctgctccgcctcctcctccatctcctacatgcactggtaccagcagaagcccggcaaggcccccaagctcctcatctacaccacctccaacctcgcctccggcgtccccgcccgcttctccggctccggctccggcaccgagttcaccctcaccatctcctccctccagcccgacgacttcgccacctactactgccaccagcgctccacctaccccctcaccttcggctccggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 15474 - RNA, 1341 nt, synthetic construct
  misc_feature 1..1341: note = derived and/or modified sequence opt2 from Dalotuzumab_HeavyChain1
  source 1..1341: mol_type = other RNA
caggtccagctccagcagtccggccccggcctcgtcaagccctcccagaccctctccctcacctgcaccgtctccggctggtccatctccggcggctggctctggaactggatccgccagccccccggcaagggcctccagtggatcggctggatctcctgggacggcaccaacaactggaagccctccctcaaggaccgcgtcaccatctccgtcgacacctccaagaaccagttctccctcaagctctcctccgtcaccgccgccgacaccgccgtctggtggtgcgcccgctggggccgcgtcttcttcgactggtggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15475 - RNA, 657 nt, synthetic construct
  misc_feature 1..657: note = derived and/or modified sequence opt2 from Dalotuzumab_LightChain1
  source 1..657: mol_type = other RNA
gacatcgtcatgacccagtcccccctctccctccccgtcacccccggccagcccgcctccatctcctgccgctcctcccagtccatcgtccactccaacggcaacacctggctccagtggtggctccagaagcccggccagtccccccagctcctcatctggaaggtctccaaccgcctctggggcgtccccgaccgcttctccggctccggctccggcaccgacttcaccctcaagatctcccgcgtccaggcccaggacgtcggcgtctggtggtgcttccagggctcccacgtcccctggaccttcggccagggcaccaaggtccagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15476 - RNA, 687 nt, synthetic construct
  misc_feature 1..687: note = derived and/or modified sequence opt2 from Dapirolizumab_pegol_HeavyChain1
  source 1..687: mol_type = other RNA
gaggtccagctcgtcgagtccggcggcggcctcgtccagcccggcggctccctccgcctctcctgcgccgtctccggcttctcctccaccaactaccacgtccactgggtccgccaggcccccggcaagggcctcgagtggatgggcgtcatctggggcgacggcgacacctcctacaactccgtcctcaagtcccgcttcaccatctcccgcgacacctccaagaacaccgtctacctccagatgaactccctccgcgccgaggacaccgccgtctactactgcgcccgccagctcacccactactacgtcctcgccgcctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgcgccgcc

SEQ ID NO: 15477 - RNA, 642 nt, synthetic construct
  misc_feature 1..642: note = derived and/or modified sequence opt2 from Dapirolizumab_pegol_LightChain1
  source 1..642: mol_type = other RNA
gacatccagatgacccagtccccctcctccctctccgcctccgtcggcgaccgcgtcaccatcacctgccgcgcctccgaggacctctactacaacctcgcctggtaccagcgcaagcccggcaaggcccccaagctcctcatctacgacacctaccgcctcgccgacggcgtcccctcccgcttctccggctccggctccggcaccgactacaccctcaccatctcctccctccagcccgaggacttcgcctcctactactgccagcagtactacaagttccccttcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15478 - RNA, 1356 nt, synthetic construct
  misc_feature 1..1356: note = derived and/or modified sequence opt2 from Daratumumab_HeavyChain1
  source 1..1356: mol_type = other RNA
gaggtccagctcctcgagtccggcggcggcctcgtccagcccggcggctccctccgcctctcctgcgccgtctccggcttcaccttcaactccttcgccatgtcctgggtccgccaggcccccggcaagggcctcgagtgggtctccgccatctccggctccggcggcggcacctactacgccgactccgtcaagggccgcttcaccatctcccgcgacaactccaagaacaccctctacctccagatgaactccctccgcgccgaggacaccgccgtctacttctgcgccaaggacaagatcctctggttcggcgagcccgtcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15479 - RNA, 642 nt, synthetic construct
  misc_feature 1..642: note = derived and/or modified sequence opt2 from Daratumumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15480 - RNA, 1350 nt, synthetic construct
  misc_feature 1..1350: note = derived and/or modified sequence opt2 from Dectrekumab_HeavyChain1
  source 1..1350: mol_type = other RNA
gaggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccatcatctggtacgacggctccaacaagtactacgccgactccgtcaagggccgcttcaccatctcccgcgacaactccaagaacaccctctacctccagatgaactccctccgcgccgaggacaccgccgtctactactgcgcccgcctctggttcggcgacctcgacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15481 - RNA, 648 nt, synthetic construct
  misc_feature 1..648: note = derived and/or modified sequence opt2 from Dectrekumab_LightChain1
  source 1..648: mol_type = other RNA
gagatcgtcctcacccagtcccccgccaccctctccctctcccccggcgagcgcgccatcctctcctgccgcgccggccagtccgtctcctcctacctcgtctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctcctcctggccccccgtctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15482 - RNA, 1332 nt, synthetic construct
  misc_feature 1..1332: note = derived and/or modified sequence opt2 from Demcizumab_HeavyChain1
  source 1..1332: mol_type = other RNA
caggtccagctcgtccagtccggcgccgaggtcaagaagcccggcgcctccgtcaagatctcctgcaaggcctccggctactccttcaccgcctactacatccactgggtcaagcaggcccccggccagggcctcgagtggatcggctacatctcctcctacaacggcgccaccaactacaaccagaagttcaagggccgcgtcaccttcaccaccgacacctccacctccaccgcctacatggagctccgctccctccgctccgacgacaccgccgtctactactgcgcccgcgactacgactacgacgtcggcatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15483 - RNA, 654 nt, synthetic construct
  misc_feature 1..654: note = derived and/or modified sequence opt2 from Demcizumab_LightChain1
  source 1..654: mol_type = other RNA
gacatcgtcatgacccagtcccccgactccctcgccgtctccctcggcgagcgcgccaccatctcctgccgcgcctccgagtccgtcgacaactacggcatctccttcatgaagtggttccagcagaagcccggccagccccccaagctcctcatctacgccgcctccaaccagggctccggcgtccccgaccgcttctccggctccggctccggcaccgacttcaccctcaccatctcctccctccaggccgaggacgtcgccgtctactactgccagcagtccaaggaggtcccctggaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15484 - RNA, 1350 nt, synthetic construct
  misc_feature 1..1350: note = derived and/or modified sequence opt2 from Denintuzumab_mafodotin_HeavyChain1
  source 1..1350: mol_type = other RNA
caggtccagctccaggagtccggccccggcctcgtcaagccctcccagaccctctccctcacctgcaccgtctccggcggctccatctccacctccggcatgggcgtcggctggatccgccagcaccccggcaagggcctcgagtggatcggccacatctggtgggacgacgacaagcgctacaaccccgccctcaagtcccgcgtcaccatctccgtcgacacctccaagaaccagttctccctcaagctctcctccgtcaccgccgccgacaccgccgtctactactgcgcccgcatggagctctggtcctactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15485 - RNA, 639 nt, synthetic construct
  misc_feature 1..639: note = derived and/or modified sequence opt2 from Denintuzumab_mafodotin_LightChain1
  source 1..639: mol_type = other RNA
gagatcgtcctcacccagtcccccgccaccctctccctctcccccggcgagcgcgccaccctctcctgctccgcctcctcctccgtctcctacatgcactggtaccagcagaagcccggccaggccccccgcctcctcatctacgacacctccaagctcgcctccggcatccccgcccgcttctccggctccggctccggcaccgacttcaccctcaccatctcctccctcgagcccgaggacgtcgccgtctactactgcttccagggctccgtctaccccttcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15486 - RNA, 1356 nt, synthetic construct
  misc_feature 1..1356: note = derived and/or modified sequence opt2 from Denosumab_HeavyChain
  source 1..1356: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtctccggcatcaccggctccggcggctccacctactacgccgactccgtcaagggccgcttcaccatctcccgcgacaactccaagaacaccctctacctccagatgaactccctccgcgccgaggacaccgccgtctactactgcgccaaggaccccggcaccaccgtcatcatgtcctggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15487 - RNA, 645 nt, synthetic construct
  misc_feature 1..645: note = derived and/or modified sequence opt2 from Denosumab_LightChain
  source 1..645: mol_type = other RNA
gagatcgtcctcacccagtcccccggcaccctctccctctcccccggcgagcgcgccaccctctcctgccgcgcctcccagtccgtccgcggccgctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtcttctactgccagcagtacggctcctccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15488 - RNA, 1338 nt, synthetic construct
  misc_feature 1..1338: note = derived and/or modified sequence opt2 from Depatuxizumab_HeavyChain1
  source 1..1338: mol_type = other RNA
caggtccagctccaggagtccggccccggcctcgtcaagccctcccagaccctctccctcacctgcaccgtctccggctactccatctcctccgacttcgcctggaactggatccgccagccccccggcaagggcctcgagtggatgggctacatctcctactccggcaacacccgctaccagccctccctcaagtcccgcatcaccatctcccgcgacacctccaagaaccagttcttcctcaagctcaactccgtcaccgccgccgacaccgccacctactactgcgtcaccgccggccgcggcttcccctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15489 - RNA, 642 nt, synthetic construct
  misc_feature 1..642: note = derived and/or modified sequence opt2 from Depatuxizumab_LightChain1
  source 1..642: mol_type = other RNA
gacatccagatgacccagtccccctcctccatgtccgtctccgtcggcgaccgcgtcaccatcacctgccactcctcccaggacatcaactccaacatcggctggctccagcagaagcccggcaagtccttcaagggcctcatctaccacggcaccaacctcgacgacggcgtcccctcccgcttctccggctccggctccggcaccgactacaccctcaccatctcctccctccagcccgaggacttcgccacctactactgcgtccagtacgcccagttcccctggaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15490 - RNA, 1338 nt, synthetic construct; identical to SEQ ID NO: 15488
  misc_feature 1..1338: note = derived and/or modified sequence opt2 from Depatuxizumab_mafodotin_HeavyChain1
  source 1..1338: mol_type = other RNA

SEQ ID NO: 15491 - RNA, 642 nt, synthetic construct; identical to SEQ ID NO: 15489
  misc_feature 1..642: note = derived and/or modified sequence opt2 from Depatuxizumab_mafodotin_LightChain1
  source 1..642: mol_type = other RNA

SEQ ID NO: 15492 - RNA, 1329 nt, synthetic construct
  misc_feature 1..1329: note = derived and/or modified sequence opt2 from Dinutuximab_beta_HeavyChain1
  source 1..1329: mol_type = other RNA
gaggtccagctcctccagtccggccccgagctcgagaagcccggcgcctccgtcatgatctcctgcaaggcctccggctcctccttcaccggctacaacatgaactgggtccgccagaacatcggcaagtccctcgagtggatcggcgccatcgacccctactacggcggcacctcctacaaccagaagttcaagggccgcgccaccctcaccgtcgacaagtcctcctccaccgcctacatgcacctcaagtccctcacctccgaggactccgccgtctactactgcgtctccggcatggagtactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15493 - RNA, 660 nt, synthetic construct
  misc_feature 1..660: note = derived and/or modified sequence opt2 from Dinutuximab_beta_LightChain1
  source 1..660: mol_type = other RNA
gagatcgtcatgacccagtcccccgccaccctctccgtctcccccggcgagcgcgccaccctctcctgccgctcctcccagtccctcgtccaccgcaacggcaacacctacctccactggtacctccagaagcccggccagtcccccaagctcctcatccacaaggtctccaaccgcttctccggcgtccccgaccgcttctccggctccggctccggcaccgacttcaccctcaagatctcccgcgtcgaggccgaggacctcggcgtctacttctgctcccagtccacccacgtcccccccctcaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15494 - RNA, 1329 nt, synthetic construct; identical to SEQ ID NO: 15492
  misc_feature 1..1329: note = derived and/or modified sequence opt2 from Dinutuximab_HeavyChain1
  source 1..1329: mol_type = other RNA

SEQ ID NO: 15495 - RNA, 660 nt, synthetic construct; identical to SEQ ID NO: 15493
  misc_feature 1..660: note = derived and/or modified sequence opt2 from Dinutuximab_LightChain1
  source 1..660: mol_type = other RNA

SEQ ID NO: 15496 - RNA, 660 nt, synthetic construct; identical to SEQ ID NO: 15493
  misc_feature 1..660: note = derived and/or modified sequence opt2 from Dinutuximab_LightChain
  source 1..660: mol_type = other RNA

SEQ ID NO: 15497 - RNA, 1350 nt, synthetic construct
  misc_feature 1..1350: note = derived and/or modified sequence opt2 from Diridavumab_HeavyChain1
  source 1..1350: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15498 - RNA, 651 nt, synthetic construct
  misc_feature 1..651: note = derived and/or modified sequence opt2 from Diridavumab_LightChain1
  source 1..651: mol_type = other RNA
cagtccgtcctcacccagcccccctccgtctccgccgcccccggccagaaggtcaccatctcctgctccggctcctcctccaacatcggcaacgactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccaactactactgcgccacctgggaccgccgccccaccgcctacgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15499 - RNA, 1338 nt, synthetic construct
  misc_feature 1..1338: note = derived and/or modified sequence opt2 from Domagrozumab_HeavyChain1
  source 1..1338: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtctccaccatctcctccggcggctcctacacctcctaccccgactccgtcaagggccgcttcaccatctcccgcgacaactccaagaacaccctctacctccagatgaactccctccgcgccgaggacaccgccgtctactactgcgccaagcaggactacgccatgaactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15500 - RNA, 1335 nt, synthetic construct
  misc_feature 1..1335: note = derived and/or modified sequence opt2 from Domagrozumab_HeavyChain
  source 1..1335: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtctccaccatctcctccggcggctcctacacctcctaccccgactccgtcaagggccgcttcaccatctcccgcgacaactccaagaacaccctctacctccagatgaactccctccgcgccgaggacaccgccgtctactactgcgccaagcaggactacgccatgaactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15501 - RNA, 642 nt, synthetic construct
  misc_feature 1..642: note = derived and/or modified sequence opt2 from Domagrozumab_LightChain1
  source 1..642: mol_type = other RNA
gacatccagatgacccagtccccctcctccctctccgcctccgtcggcgaccgcgtcaccatcacctgcaaggcctcccaggacgtctccaccgccgtcgcctggtaccagcagaagcccggcaaggcccccaagctcctcatctactccgcctcctaccgctacaccggcgtcccctcccgcttctccggctccggctccggcaccgacttcaccctcaccatctcctccctccagcccgaggacttcgccacctactactgccagcagcactactccaccccctggaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15502 - RNA, 1335 nt, synthetic construct
  misc_feature 1..1335: note = derived and/or modified sequence opt2 from Drozituab_HeavyChain1
  source 1..1335: mol_type = other RNA
gaggtccagctcgtccagtccggcggcggcgtcgagcgccccggcggctccctccgcctctcctgcgccgcctccggcttcaccttcgacgactacgcctcctgggtccgccaggcccccggcaagggcctcgagtgggtctccggcatcaactggcagggcggctccaccggctacgccgactccgtcaagggccgcgtcaccatctcccgcgacaacgccaagaactccctctacctccagaactccctccgcgccgaggacaccgccgtctactactgcgccaagatcctcggcgccggccgcggctggtacttcgactactggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 15503 - RNA, 639 nt, synthetic construct
  misc_feature 1..639: note = derived and/or modified sequence opt2 from Drozituab_LightChain1
  source 1..639: mol_type = other RNA
tccgagctcacccaggaccccgccgtctccgtcgccctcggccagaccgtccgcatcacctgctccggcgactccctccgctcctactacgcctcctggtaccagcagaagcccggccaggcccccgtcctcgtcatctacggcgccaacaaccgcccctccggcatccccgaccgcttctccggctcctcctccggcaacaccgcctccctcaccatcaccggcgcccaggccgaggacgaggccgactactactgcaactccgccgactcctccggcaaccacgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 15504 - RNA, 1353 nt, synthetic construct
  misc_feature 1..1353: note = derived and/or modified sequence opt2 from Drozitumab_HeavyChain1
  source 1..1353: mol_type = other RNA
gaggtccagctcgtccagtccggcggcggcgtcgagcgccccggcggctccctccgcctctcctgcgccgcctccggcttcaccttcgacgactacgccatgtcctgggtccgccaggcccccggcaagggcctcgagtgggtctccggcatcaactggcagggcggctccaccggctacgccgactccgtcaagggccgcgtcaccatctcccgcgacaacgccaagaactccctctacctccagatgaactccctccgcgccgaggacaccgccgtctactactgcgccaagatcctcggcgccggccgcggctggtacttcgactactggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15505 - RNA, 639 nt, synthetic construct; identical to SEQ ID NO: 15503
  misc_feature 1..639: note = derived and/or modified sequence opt2 from Drozitumab_LightChain1
  source 1..639: mol_type = other RNA

SEQ ID NO: 15506 - RNA, 1353 nt, synthetic construct
  misc_feature 1..1353: note = derived and/or modified sequence opt2 from Duligotumab_HeavyChain1
  source 1..1353: mol_type = other RNA
gaggtccagctcgtcgagtccggcggcggcctcgtccagcccggcggctccctccgcctctcctgcgccgcctccggcttcaccctctccggcgactggatccactgggtccgccaggcccccggcaagggcctcgagtgggtcggcgagatctccgccgccggcggctacaccgactacgccgactccgtcaagggccgcttcaccatctccgccgacacctccaagaacaccgcctacctccagatgaactccctccgcgccgaggacaccgccgtctactactgcgcccgcgagtcccgcgtctccttcgaggccgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15507 - RNA, 642 nt, synthetic construct
  misc_feature 1..642: note = derived and/or modified sequence opt2 from Duligotumab_LightChain1
  source 1..642: mol_type = other RNA
gacatccagatgacccagtccccctcctccctctccgcctccgtcggcgaccgcgtcaccatcacctgccgcgcctcccagaacatcgccaccgacgtcgcctggtaccagcagaagcccggcaaggcccccaagctcctcatctactccgcctccttcctctactccggcgtcccctcccgcttctccggctccggctccggcaccgacttcaccctcaccatctcctccctccagcccgaggacttcgccacctactactgccagcagtccgagcccgagccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15508 - RNA, 1353 nt, synthetic construct; identical to SEQ ID NO: 15506
  misc_feature 1..1353: note = derived and/or modified sequence opt2 from Duligotuzumab_HeavyChain1
  source 1..1353: mol_type = other RNA

SEQ ID NO: 15509 - RNA, 642 nt, synthetic construct; identical to SEQ ID NO: 15507
  misc_feature 1..642: note = derived and/or modified sequence opt2 from Duligotuzumab_LightChain1
  source 1..642: mol_type = other RNA

SEQ ID NO: 15510 - RNA, 1353 nt, synthetic construct
  misc_feature 1..1353: note = derived and/or modified sequence opt2 from Dupilumab_HeavyChain1
  source 1..1353: mol_type = other RNA
gaggtccagctcgtcgagtccggcggcggcctcgagcagcccggcggctccctccgcctctcctgcgccggctccggcttcaccttccgcgactacgccatgacctgggtccgccaggcccccggcaagggcctcgagtgggtctcctccatctccggctccggcggcaacacctactacgccgactccgtcaagggccgcttcaccatctcccgcgacaactccaagaacaccctctacctccagatgaactccctccgcgccgaggacaccgccgtctactactgcgccaaggaccgcctctccatcaccatccgcccccgctactacggcctcgacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15511 - RNA, 657 nt, synthetic construct
  misc_feature 1..657: note = derived and/or modified sequence opt2 from Dupilumab_LightChain1
  source 1..657: mol_type = other RNA
gacatcgtcatgacccagtcccccctctccctccccgtcacccccggcgagcccgcctccatctcctgccgctcctcccagtccctcctctactccatcggctacaactacctcgactggtacctccagaagtccggccagtccccccagctcctcatctacctcggctccaaccgcgcctccggcgtccccgaccgcttctccggctccggctccggcaccgacttcaccctcaagatctcccgcgtcgaggccgaggacgtcggcttctactactgcatgcaggccctccagaccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15512 - RNA, 1353 nt, synthetic construct
  misc_feature 1..1353: note = derived and/or modified sequence opt2 from Durvalumab_HeavyChain1
  source 1..1353: mol_type = other RNA
gaggtccagctcgtcgagtccggcggcggcctcgtccagcccggcggctccctccgcctctcctgcgccgcctccggcttcaccttctcccgctactggatgtcctgggtccgccaggcccccggcaagggcctcgagtgggtcgccaacatcaagcaggacggctccgagaagtactacgtcgactccgtcaagggccgcttcaccatctcccgcgacaacgccaagaactccctctacctccagatgaactccctccgcgccgaggacaccgccgtctactactgcgcccgcgagggcggctggttcggcgagctcgccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagttcgagggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcctccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15513 - RNA, 645 nt, synthetic construct
  misc_feature 1..645: note = derived and/or modified sequence opt2 from Durvalumab_LightChain1
  source 1..645: mol_type = other RNA
gagatcgtcctcacccagtcccccggcaccctctccctctcccccggcgagcgcgccaccctctcctgccgcgcctcccagcgcgtctcctcctcctacctcgcctggtaccagcagaagcccggccaggccccccgcctcctcatctacgacgcctcctcccgcgccaccggcatccccgaccgcttctccggctccggctccggcaccgacttcaccctcaccatctcccgcctcgagcccgaggacttcgccgtctactactgccagcagtacggctccctcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15514 - RNA, 1338 nt, synthetic construct
  misc_feature 1..1338: note = derived and/or modified sequence opt2 from Dusigitumab_HeavyChain1
  source 1..1338: mol_type = other RNA
caggtccagctcgtccagtccggcgccgaggtcaagaagcccggcgcctccgtcaaggtctcctgcaaggcctccggctacaccttcacctcctacgacatcaactgggtccgccaggccaccggccagggcctcgagtggatgggctggatgaaccccaactccggcaacaccggctacgcccagaagttccagggccgcgtcaccatgacccgcaacacctccatctccaccgcctacatggagctctcctccctccgctccgaggacaccgccgtctactactgcgcccgcgacccctactactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15515 - RNA, 651 nt, synthetic construct
  misc_feature 1..651: note = derived and/or modified sequence opt2 from Dusigitumab_LightChain1
  source 1..651: mol_type = other RNA
cagtccgtcctcacccagcccccctccgtctccgccgcccccggccagaaggtcaccatctcctgctccggctcctcctccaacatcgagaacaaccacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcgagacctgggacacctccctctccgccggccgcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15516 - RNA, 1347 nt, synthetic construct
  misc_feature 1..1347: note = derived and/or modified sequence opt2 from Ecromeximab_HeavyChain1
  source 1..1347: mol_type = other RNA
gaggtcaccctcgtcgagtccggcggcgacttcgtcaagcccggcggctccctcaaggtctcctgcgccgcctccggcttcgccttctcccactacgccatgtcctgggtccgccagacccccgccaagcgcctcgagtgggtcgcctacatctcctccggcggctccggcacctactactccgactccgtcaagggccgcttcaccatctcccgcgacaacgccaagaacaccctctacctccagatgcgctccctccgctccgaggactccgccatgtacttctgcacccgcgtcaagctcggcacctactacttcgactcctggggccagggcaccaccctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15517 - RNA, 642 nt, synthetic construct
  misc_feature 1..642: note = derived and/or modified sequence opt2 from Ecromeximab_LightChain1
  source 1..642: mol_type = other RNA
gacatccagatgacccagaccgcctcctccctccccgcctccctcggcgaccgcgtcaccatctcctgctccgcctcccaggacatctccaactacctcaactggtaccagcagaagcccgacggcaccgtcaagctcctcatcttctactcctccaacctccactccggcgtcccctcccgcttctccggcggcggctccggcaccgactactccctcaccatctccaacctcgagcccgaggacatcgccacctacttctgccaccagtactccaagctcccctggaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15518 - RNA, 1341 nt, synthetic construct
  misc_feature 1..1341: note = derived and/or modified sequence opt2 from Eculizumab_HeavyChain1
  source 1..1341: mol_type = other RNA
gtccagctcgtccagtccggcgccgaggtcaagaagcccggcgcctccgtcaaggtctcctgcaaggcctccggctacatcttctccaactactggatccagtgggtccgccaggcccccggccagggcctcgagtggatgggcgagatcctccccggctccggctccaccgagtacaccgagaacttcaaggaccgcgtcaccatgacccgcgacacctccacctccaccgtctacatggagctctcctccctccgctccgaggacaccgccgtctactactgcgcccgctacttcttcggctcctcccccaactggtacttcgacgtctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15519 - RNA, 642 nt, synthetic construct
  misc_feature 1..642: note = derived and/or modified sequence opt2 from Eculizumab_LightChain1
  source 1..642: mol_type = other RNA
gacatccagatgacccagtccccctcctccctctccgcctccgtcggcgaccgcgtcaccatcacctgcggcgcctccgagaacatctacggcgccctcaactggtaccagcagaagcccggcaaggcccccaagctcctcatctacggcgccaccaacctcgccgacggcgtcccctcccgcttctccggctccggctccggcaccgacttcaccctcaccatctcctccctccagcccgaggacttcgccacctactactgccagaacgtcctcaacacccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15520 - RNA, 375 nt, synthetic construct
  misc_feature 1..375: note = derived and/or modified sequence opt2 from Efalizumab_HeavyChain
  source 1..375: mol_type = other RNA
gaggtccagctcgtcgagtccggcggcggcctcgtccagcccggcggctccctccgcctctcctgcgccgcctccggctactccttcaccggccactggatgaactgggtccgccaggcccccggcaagggcctcgagtgggtcggcatcatgatccacccctccgactccgagacccgctacaaccagaagttcaaggacatccgcttcaccatctccgtcgacaagtccaagaacaccctctacctccagatgaactccctccgcgccgaggacaccgccgtctactactgcgcccgcatcggcatctacttctacggcaccacctacttcgactacatctggggccagggcaccctcgtcaccgtctcctcc

SEQ ID NO: 15521 - RNA, 324 nt, synthetic construct
  misc_feature 1..324: note = derived and/or modified sequence opt2 from Efalizumab_LightChain
  source 1..324: mol_type = other RNA
gacatccagatgacccagtccccctcctccctctccgcctccgtcggcgaccgcgtcaccatcacctgccgcgcctccaagaccatctccaagtacctcgcctggtaccagcagaagcccggcaaggcccccaagctcctcatctactccggctccaccctccagtccggcgtcccctcccgcttctccggctccggctccggcaccgacttcaccctcaccatctcctccctccagcccgaggacttcgccacctactactgccagcagcacaacgagtaccccctcaccttcggccagggcaccaaggtcgagatcaagcgc

SEQ ID NO: 15522 - RNA, 768 nt, synthetic construct
  misc_feature 1..768: note = derived and/or modified sequence opt2 from Efungumab_SingleChain_variable_fragment
  source 1..768: mol_type = other RNA
atggccgaggtccagctcgtcgagtccggcgccgaggtcaagaagcccggcgagtccctccgcatctcctgcaagggctccggctgcatcatctcctcctactggatctcctgggtccgccagatgcccggcaagggcctcgagtggatgggcaagatcgaccccggcgactcctacatcaactactccccctccttccagggccacgtcaccatctccgccgacaagtccatcaacaccgcctacctccagtggaactccctcaaggcctccgacaccgccatgtactactgcgcccgcggcggccgcgacttcggcgactccttcgactactggggccagggcaccctcgtcaccgtctcctccggcggcggcggctccggcggcggcggctccggcggcggcggctccgacgtcgtcatgacccagtccccctccttcctctccgccttcgtcggcgaccgcatcaccatcacctgccgcgcctcctccggcatctcccgctacctcgcctggtaccagcaggcccccggcaaggcccccaagctcctcatctacgccgcctccaccctccagaccggcgtcccctcccgcttctccggctccggctccggcaccgagttcaccctcaccatcaactccctccagcccgaggacttcgccacctactactgccagcacctcaactcctaccccctcaccttcggcggcggcaccaaggtcgacatcaagcgcgccgccgccctcgagcaccaccaccaccaccac

SEQ ID NO: 15523 - RNA, 1362 nt, synthetic construct
  misc_feature 1..1362: note = derived and/or modified sequence opt2 from Eldelumab_HeavyChain1
  source 1..1362: mol_type = other RNA
cagatgcagctcgtcgagtccggcggcggcgtcgtccagcccggccgctccctccgcctctcctgcaccgcctccggcttcaccttctccaacaacggcatgcactgggtccgccaggcccccggcaagggcctcgagtgggtcgccgtcatctggttcgacggcatgaacaagttctacgtcgactccgtcaagggccgcttcaccatctcccgcgacaactccaagaacaccctctacctcgagatgaactccctccgcgccgaggacaccgccatctactactgcgcccgcgagggcgacggctccggcatctactactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15524 - RNA, 648 nt, synthetic construct
  misc_feature 1..648: note = derived and/or modified sequence opt2 from Eldelumab_LightChain1
  source 1..648: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctcccccatcttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15525 - RNA, 1341 nt, synthetic construct
  misc_feature 1..1341: note = derived and/or modified sequence opt2 from Elgemtumab_HeavyChain1
  source 1..1341: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtctccgccatcaactcccagggcaagtccacctactacgccgactccgtcaagggccgcttcaccatctcccgcgacaactccaagaacaccctctacctccagatgaactccctccgcgccgaggacaccgccgtctactactgcgcccgctggggcgacgagggcttcgacatctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15526 - RNA, 642 nt, synthetic construct
  misc_feature 1..642: note = derived and/or modified sequence opt2 from Elgemtumab_LightChain1
  source 1..642: mol_type = other RNA
gacatccagatgacccagtccccctcctccctctccgcctccgtcggcgaccgcgtcaccatcacctgccgcgcctcccagggcatctccaactggctcgcctggtaccagcagaagcccggcaaggcccccaagctcctcatctacggcgcctcctccctccagtccggcgtcccctcccgcttctccggctccggctccggcaccgacttcaccctcaccatctcctccctccagcccgaggacttcgccacctactactgccagcagtactcctccttccccaccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15527 - RNA, 1347 nt, synthetic construct
  misc_feature 1..1347: note = derived and/or modified sequence opt2 from Elotuzumab_HeavyChain1
  source 1..1347: mol_type = other RNA
gaggtccagctcgtcgagtccggcggcggcctcgtccagcccggcggctccctccgcctctcctgcgccgcctccggcttcgacttctcccgctactggatgtcctgggtccgccaggcccccggcaagggcctcgagtggatcggcgagatcaaccccgactcctccaccatcaactacgccccctccctcaaggacaagttcatcatctcccgcgacaacgccaagaactccctctacctccagatgaactccctccgcgccgaggacaccgccgtctactactgcgcccgccccgacggcaactactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15528 - RNA, 642 nt, synthetic construct
  misc_feature 1..642: note = derived and/or modified sequence opt2 from Elotuzumab_LightChain1
  source 1..642: mol_type = other RNA
gacatccagatgacccagtccccctcctccctctccgcctccgtcggcgaccgcgtcaccatcacctgcaaggcctcccaggacgtcggcatcgccgtcgcctggtaccagcagaagcccggcaaggtccccaagctcctcatctactgggcctccacccgccacaccggcgtccccgaccgcttctccggctccggctccggcaccgacttcaccctcaccatctcctccctccagcccgaggacgtcgccacctactactgccagcagtactcctcctacccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15529 - RNA, 1338 nt, synthetic construct
  misc_feature 1..1338: note = derived and/or modified sequence opt2 from Emactuzumab_HeavyChain1
  source 1..1338: mol_type = other RNA
caggtccagctcgtccagtccggcgccgaggtcaagaagcccggcgcctccgtcaaggtctcctgcaaggcctccggctacaccttcacctcctacgacatctcctgggtccgccaggcccccggccagggcctcgagtggatgggcgtcatctggaccgacggcggcaccaactacgcccagaagctccagggccgcgtcaccatgaccaccgacacctccacctccaccgcctacatggagctccgctccctccgctccgacgacaccgccgtctactactgcgcccgcgaccagcgcctctacttcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15530 - RNA, 639 nt, synthetic construct
  misc_feature 1..639: note = derived and/or modified sequence opt2 from Emactuzumab_LightChain1
  source 1..639: mol_type = other RNA
gacatccagatgacccagtccccctcctccctctccgcctccgtcggcgaccgcgtcaccatcacctgccgcgcctccgaggacgtcaacacctacgtctcctggtaccagcagaagcccggcaaggcccccaagctcctcatctacgccgcctccaaccgctacaccggcgtcccctcccgcttctccggctccggctccggcaccgacttcaccctcaccatctcctccctccagcccgaggacttcgccacctactactgccagcagtccttctcctaccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15531 - RNA, 1323 nt, synthetic construct
  misc_feature 1..1323: note = derived and/or modified sequence opt2 from Emibetuzumab_HeavyChain1
  source 1..1323: mol_type = other RNA
caggtccagctcgtccagtccggcgccgaggtcaagaagcccggcgcctccgtcaaggtctcctgcaaggcctccggctacaccttcaccgactactacatgcactgggtccgccaggcccccggccagggcctcgagtggatgggccgcgtcaaccccaaccgccgcggcaccacctacaaccagaagttcgagggccgcgtcaccatgaccaccgacacctccacctccaccgcctacatggagctccgctccctccgctccgacgacaccgccgtctactactgcgcccgcgccaactggctcgactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgaggccgccggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15532 - RNA, 645 nt, synthetic construct
  misc_feature 1..645: note = derived and/or modified sequence opt2 from Emibetuzumab_LightChain1
  source 1..645: mol_type = other RNA
gacatccagatgacccagtccccctcctccctctccgcctccgtcggcgaccgcgtcaccatcacctgctccgtctcctcctccgtctcctccatctacctccactggtaccagcagaagcccggcaaggcccccaagctcctcatctactccacctccaacctcgcctccggcgtcccctcccgcttctccggctccggctccggcaccgacttcaccctcaccatctcctccctccagcccgaggacttcgccacctactactgccaggtctactccggctaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15533 - RNA, 1344 nt, synthetic construct
  misc_feature 1..1344: note = derived and/or modified sequence opt2 from Emicizumab_HeavyChain1
  source 1..1344: mol_type = other RNA
caggtccagctcgtcgagtccggcggcggcctcgtccagcccggcggctccctccgcctctcctgcgccgcctccggcttcaccttctcctactacgacatccagtgggtccgccaggcccccggcaagggcctcgagtgggtctcctccatctccccctccggccagtccacctactaccgccgcgaggtcaagggccgcttcaccatctcccgcgacaactccaagaacaccctctacctccagatgaactccctccgcgccgaggacaccgccgtctactactgcgcccgccgcaccggccgcgagtacggcggcggctggtacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccagaaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcaggagggcaacgtcttctcctgctccgtcatgcacgaggccctccacaaccgctacacccagaagtccctctccctctccccc

SEQ ID NO: 15534 - RNA, 1332 nt, synthetic construct
  misc_feature 1..1332: note = derived and/or modified sequence opt2 from Emicizumab_HeavyChain2
  source 1..1332: mol_type = other RNA
caggtccagctcgtccagtccggctccgagctcaagaagcccggcgcctccgtcaaggtctcctgcaaggcctccggctacaccttcaccgacaacaacatggactgggtccgccaggcccccggccagggcctcgagtggatgggcgacatcaacacccgctccggcggctccatctacaacgaggagttccaggaccgcgtcatcatgaccgtcgacaagtccaccgacaccgcctacatggagctctcctccctccgctccgaggacaccgccacctaccactgcgcccgccgcaagtcctacggctactacctcgacgagtggggcgagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcaggagggcaacgtcttctcctgctccgtcatgcacgaggccctccacaaccactacacccaggagtccctctccctctccccc

SEQ ID NO: 15535 - RNA, 642 nt, synthetic construct
  misc_feature 1..642: note = derived and/or modified sequence opt2 from Emicizumab_LightChain1
  source 1..642: mol_type = other RNA
gacatccagatgacccagtccccctcctccctctccgcctccgtcggcgaccgcgtcaccatcacctgcaaggcctcccgcaacatcgagcgccagctcgcctggtaccagcagaagcccggccaggcccccgagctcctcatctaccaggcctcccgcaaggagtccggcgtccccgaccgcttctccggctcccgctacggcaccgacttcaccctcaccatctcctccctccagcccgaggacatcgccacctactactgccagcagtactccgacccccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15536 - RNA, 1347 nt, synthetic construct
  misc_feature 1..1347: note = derived and/or modified sequence opt2 from Enavatuzumab_HeavyChain1
  source 1..1347: mol_type = other RNA
gaggtccagctcgtcgagtccggcggcggcctcgtccagcccggcggctccctccgcctctcctgcgccgcctccggcttcaccttctcctcctactggatgtcctgggtccgccaggcccccggcaagggcctcgagtgggtcgccgagatccgcctcaagtccgacaactacgccacccactacgccgagtccgtcaagggccgcttcaccatctcccgcgacgactccaagaactccctctacctccagatgaactccctccgcgccgaggacaccgccgtctactactgcaccggctactacgccgacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15537 - RNA, 654 nt, synthetic construct
  misc_feature 1..654: note = derived and/or modified sequence opt2 from Enavatuzumab_LightChain1
  source 1..654: mol_type = other RNA
gacatccagatgacccagtccccctcctccctctccgcctccgtcggcgaccgcgtcaccatcacctgccgcgcctcccagtccgtctccacctcctcctactcctacatgcactggtaccagcagaagcccggcaaggcccccaagctcctcatcaagtacgcctccaacctcgagtccggcgtcccctcccgcttctccggctccggctccggcaccgacttcaccctcaccatctcctccctccagcccgaggacttcgccacctactactgccagcactcctgggagatcccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15538 - RNA, 1341 nt, synthetic construct
  misc_feature 1..1341: note = derived and/or modified sequence opt2 from Enfortumab_HeavyChain
  source 1..1341: mol_type = other RNA
gaggtccagctcgtcgagtccggcggcggcctcgtccagcccggcggctccctccgcctctcctgcgccgcctccggcttcaccttctcctcctacaacatgaactgggtccgccaggcccccggcaagggcctcgagtgggtctcctacatctcctcctcctcctccaccatctactacgccgactccgtcaagggccgcttcaccatctcccgcgacaacgccaagaactccctctccctccagatgaactccctccgcgacgaggacaccgccgtctactactgcgcccgcgcctactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15539 - RNA, 642 nt, synthetic construct
  misc_feature 1..642: note = derived and/or modified sequence opt2 from Enfortumab_LightChain
  source 1..642: mol_type = other RNA
gacatccagatgacccagtccccctcctccgtctccgcctccgtcggcgaccgcgtcaccatcacctgccgcgcctcccagggcatctccggctggctcgcctggtaccagcagaagcccggcaaggcccccaagttcctcatctacgccgcctccaccctccagtccggcgtcccctcccgcttctccggctccggctccggcaccgacttcaccctcaccatctcctccctccagcccgaggacttcgccacctactactgccagcaggccaactccttcccccccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15540 - RNA, 1341 nt, synthetic construct; identical to SEQ ID NO: 15538
  misc_feature 1..1341: note = derived and/or modified sequence opt2 from Enfortumab_vedotin_HeavyChain1
  source 1..1341: mol_type = other RNA

SEQ ID NO: 15541 - RNA, 642 nt, synthetic construct; identical to SEQ ID NO: 15539
  misc_feature 1..642: note = derived and/or modified sequence opt2 from Enfortumab_vedotin_LightChain1
  source 1..642: mol_type = other RNA

SEQ ID NO: 15542 - RNA, 1356 nt, synthetic construct
  misc_feature 1..1356: note = derived and/or modified sequence opt2 from Enoblituzumab_HeavyChain
  source 1..1356: mol_type = other RNA
gaggtccagctcgtcgagtccggcggcggcctcgtccagcccggcggctccctccgcctctcctgcgccgcctccggcttcaccttctcctccttcggcatgcactgggtccgccaggcccccggcaagggcctcgagtgggtcgcctacatctcctccgactcctccgccatctactacgccgacaccgtcaagggccgcttcaccatctcccgcgacaacgccaagaactccctctacctccagatgaactccctccgcgacgaggacaccgccgtctactactgcggccgcggccgcgagaacatctactacggctcccgcctcgactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcgtcggcggcccctccgtcttcctcctcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccccgaggagcagtacaactccaccctccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccacccccctcgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15543 - RNA, 642 nt, synthetic construct
  misc_feature 1..642: note = derived and/or modified sequence opt2 from Enoblituzumab_LightChain
  source 1..642: mol_type = other RNA
gacatccagctcacccagtccccctccttcctctccgcctccgtcggcgaccgcgtcaccatcacctgcaaggcctcccagaacgtcgacaccaacgtcgcctggtaccagcagaagcccggcaaggcccccaaggccctcatctactccgcctcctaccgctactccggcgtcccctcccgcttctccggctccggctccggcaccgacttcaccctcaccatctcctccctccagcccgaggacttcgccacctactactgccagcagtacaacaactaccccttcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15544 - RNA, 1356 nt, synthetic construct
  misc_feature 1..1356: note = derived and/or modified sequence opt2 from Enokizumab_HeavyChain1
  source 1..1356: mol_type = other RNA
caggtccagctcgtccagtccggcgccgaggtcaagaagcccggctcctccgtcaaggtctcctgcaaggcctccggcggcaccttctcctactactggatcgagtgggtccgccaggcccccggccagggcctcgagtggatgggcgagatcctccccggctccggcaccaccaaccccaacgagaagttcaagggccgcgtcaccatcaccgccgacgagtccacctccaccgcctacatggagctctcctccctccgctccgaggacaccgccgtctactactgcgcccgcgccgactactacggctccgactacgtcaagttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15545 - RNA, 642 nt, synthetic construct
  misc_feature 1..642: note = derived and/or modified sequence opt2 from Enokizumab_LightChain1
  source 1..642: mol_type = other RNA
gacatccagatgacccagtccccctcctccctctccgcctccgtcggcgaccgcgtcaccatcacctgcaaggcctcccagcacgtcatcacccacgtcacctggtaccagcagaagcccggcaaggcccccaagctcctcatctacggcacctcctactcctactccggcgtcccctcccgcttctccggctccggctccggcaccgacttcaccctcaccatctcctccctccagcccgaggacttcgccacctactactgccagcagttctacgagtaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15546 - RNA, 612 nt, synthetic construct
  misc_feature 1..612: note = derived and/or modified sequence opt2 from Enokizumab_LightChain
  source 1..612: mol_type = other RNA
gacatccagatgacccagtccccctcctccctctccgcctccgtcggcgaccgcgtcaccatcacctgcaaggcctcccagcacgtcatcacccacgtcacctggtaccagcagaagcccggcaaggcccccaagctcctcatctacggcacctcctactcctactccggcgtcccctcccgcttctccggctccggctccggcaccgacttcaccctcaccatctcctccctccagcccgaggacttcgccacctactactgccagcagttctacgagtaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15547 - RNA, 1356 nt, synthetic construct
  misc_feature 1..1356: note = derived and/or modified sequence opt2 from Enoticumab_HeavyChain1
  source 1..1356: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtctccttcctctggtacgacggcaccaacaagaactacgtcgagtccgtcaagggccgcttcaccatctcccgcgacaactccaagaacatgctctacctcgagatgaactccctccgcgccgaggacaccgccgtctactactgcgcccgcgaccacgacttccgctccggctacgagggctggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15548 - RNA, 642 nt, synthetic construct
  misc_feature 1..642: note = derived and/or modified sequence opt2 from Enoticumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcaccgctccaactggccccccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15549 - RNA, 1329 nt, synthetic construct
  misc_feature 1..1329: note = derived and/or modified sequence opt2 from Ensituximab_HeavyChain1
  source 1..1329: mol_type = other RNA
caggtccagctcaaggagtccggccccgacctcgtcgccccctcccagtccctctccatcacctgcaccgtctccggcttctccctctccaagttcggcgtcaactgggtccgccagccccccggcaagggcctcgagtggctcggcgtcatctggggcgacggctccacctcctacaactccggcctcatctcccgcctctccatctccaaggagaactccaagtcccaggtcttcctcaagctcaactccctccaggccgacgacaccgccacctactactgcgtcaagcccggcggcgactactggggccacggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcccctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccatgccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15550 - RNA, 639 nt, synthetic construct
  misc_feature 1..639: note = derived and/or modified sequence opt2 from Ensituximab_LightChain1
  source 1..639: mol_type = other RNA
caggtcgtcctcacccagtcccccgtcatcatgtccgcctcccccggcgagaaggtcaccatgacctgctccgcctcctcctccatctcctacatgtactggtaccagcagaagcccggcacctcccccaagcgctggatctacgacacctccaagctcgcctccggcgtccccgcccgcttctccggctccggctccggcacctcctactccctcaccatctccaacatggaggccggcgacgccgccacctactactgccaccagcgcgactcctacccctggaccttcggcggcggcaccaacctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15551 - RNA, 768 nt, synthetic construct; identical to SEQ ID NO: 15522
  misc_feature 1..768: note = derived and/or modified sequence opt2 from Ensituximab_SingleChain_variable_fragment
  source 1..768: mol_type = other RNA

SEQ ID NO: 15552 - RNA, 987 nt, synthetic construct
  misc_feature 1..987: note = derived and/or modified sequence opt2 from Entolimod_chain1
  source 1..987: mol_type = other RNA
atgcgcggctcccaccaccaccaccaccacggcatggcctccatgaccggcggccagcagatgggccgcgacctctacgacgacgacgacaaggaccccatggcccaggtcatcaacaccaactccctctccctcctcacccagaacaacctcaacaagtcccagtcctccctctcctccgccatcgagcgcctctcctccggcctccgcatcaactccgccaaggacgacgccgccggccaggccatcgccaaccgcttcacctccaacatcaagggcctcacccaggcctcccgcaacgccaacgacggcatctccatcgcccagaccaccgagggcgccctcaacgagatcaacaacaacctccagcgcgtccgcgagctctccgtccaggccaccaacggcaccaactccgactccgacctcaagtccatccaggacgagatccagcagcgcctcgaggagatcgaccgcgtctccaaccagacccagttcaacggcgtcaaggtcctctcccaggacaaccagatgaagatccaggtcggcgccaacgacggcgagaccatcaccatcgacctccagaagatcgacgtcaagtccctcggcctcgacggcttcaacgtcaactcccccggcatctccggcggcggcggcggcatcctcgactccatgggcaccctcatcaacgaggacgccgccgccgccaagaagtccaccgccaaccccctcgcctccatcgactccgccctctccaaggtcgacgccgtccgctcctccctcggcgccatccagaaccgcttcgactccgccatcaccaacctcggcaacaccgtcaccaacctcaactccgcccgctcccgcatcgaggacgccgactacgccaccgaggtctccaacatgtccaaggcccagatcctccagcaggccggcacctccgtcctcgcccaggccaaccaggtcccccagaacgtcctctccctcctccgc

SEQ ID NO: 15553 - RNA, 1338 nt, synthetic construct
  misc_feature 1..1338: note = derived and/or modified sequence opt2 from Epratuzumab_HeavyChain
  source 1..1338: mol_type = other RNA
caggtccagctcgtccagtccggcgccgaggtcaagaagcccggctcctccgtcaaggtctcctgcaaggcctccggctacaccttcacctcctactggctccactgggtccgccaggcccccggccagggcctcgagtggatcggctacatcaacccccgcaacgactacaccgagtacaaccagaacttcaaggacaaggccaccatcaccgccgacgagtccaccaacaccgcctacatggagctctcctccctccgctccgaggacaccgccttctacttctgcgcccgccgcgacatcaccaccttctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15554 - RNA, 657 nt, synthetic construct
  misc_feature 1..657: note = derived and/or modified sequence opt2 from Epratuzumab_LightChain
  source 1..657: mol_type = other RNA
gacatccagctcacccagtccccctcctccctctccgcctccgtcggcgaccgcgtcaccatgtcctgcaagtcctcccagtccgtcctctactccgccaaccacaagaactacctcgcctggtaccagcagaagcccggcaaggcccccaagctcctcatctactgggcctccacccgcgagtccggcgtcccctcccgcttctccggctccggctccggcaccgacttcaccttcaccatctcctccctccagcccgaggacatcgccacctactactgccaccagtacctctcctcctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15555 - RNA, 762 nt, synthetic construct
  misc_feature 1..762: note = derived and/or modified sequence opt2 from Eptacog_beta_HeavyChain1
  source 1..762: mol_type = other RNA
atcgtcggcggcaaggtctgccccaagggcgagtgcccctggcaggtcctcctcctcgtcaacggcgcccagctctgcggcggcaccctcatcaacaccatctgggtcgtctccgccgcccactgcttcgacaagatcaagaactggcgcaacctcatcgccgtcctcggcgagcacgacctctccgagcacgacggcgacgagcagtcccgccgcgtcgcccaggtcatcatcccctccacctacgtccccggcaccaccaaccacgacatcgccctcctccgcctccaccagcccgtcgtcctcaccgaccacgtcgtccccctctgcctccccgagcgcaccttctccgagcgcaccctcgccttcgtccgcttctccctcgtctccggctggggccagctcctcgaccgcggcgccaccgccctcgagctcatggtcctcaacgtcccccgcctcatgacccaggactgcctccagcagtcccgcaaggtcggcgactcccccaacatcaccgagtacatgttctgcgccggctactccgacggctccaaggactcctgcaagggcgactccggcggcccccacgccacccactaccgcggcacctggtacctcaccggcatcgtctcctggggccagggctgcgccaccgtcggccacttcggcgtctacacccgcgtctcccagtacatcgagtggctccagaagctcatgcgctccgagccccgccccggcgtcctcctccgcgcccccttcccc

SEQ ID NO: 15556 - RNA, 456 nt, synthetic construct
  misc_feature 1..456: note = derived and/or modified sequence opt2 from Eptacog_beta_LightChain1
  source 1..456: mol_type = other RNA
gccaacgccttcctcgaggagctccgccccggctccctcgagcgcgagtgcaaggaggagcagtgctccttcgaggaggcccgcgagatcttcaaggacgccgagcgcaccaagctcttctggatctcctactccgacggcgaccagtgcgcctcctccccctgccagaacggcggctcctgcaaggaccagctccagtcctacatctgcttctgcctccccgccttcgagggccgcaactgcgagacccacaaggacgaccagctcatctgcgtcaacgagaacggcggctgcgagcagtactgctccgaccacaccggcaccaagcgctcctgccgctgccacgagggctactccctcctcgccgacggcgtctcctgcacccccaccgtcgagtacccctgcggcaagatccccatcctcgagaagcgcaacgcctccaagccccagggccgc

SEQ ID NO: 15557 - RNA, 708 nt, synthetic construct
  misc_feature 1..708: note = derived and/or modified sequence opt2 from Erlizuab_HeavyChain1
  source 1..708: mol_type = other RNA
gaggtccagctcgtcgagtccggcggcggcctcgtccagcccggcggctccctccgcctctcctgcgccacctccggctacaccttcaccgagtacacccactggcgccaggcccccggcaagggcctcgagtgggtcgccggcatcaaccccaagaacggcggcacctcccacaaccagcgcttcgaccgcttcaccatctccgtcgacaagtccacctccaccgcctaccagaactccctccgcgccgaggacaccgccgtctactactgcgcccgctggcgcggcctcaactacggcttcgacgtccgctacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctc

SEQ ID NO: 15558 - RNA, 639 nt, synthetic construct
  misc_feature 1..639: note = derived and/or modified sequence opt2 from Erlizuab_LightChain1
  source 1..639: mol_type = other RNA
gacatccagacccagtccccctcctccctctccgcctccgtcggcgaccgcgtcaccatcacctgccgcgcctcccaggacatcaacaactacctcaactggtaccagcagaagcccggcaaggcccccaagctcctcatctactacacctccaccctccactccggcgtcccctcccgcttctccggctccggctccggcaccgactacaccctcaccatctcctccctccagcccgaggacttcgccacctactactgccagcagggcaacaccctcccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15559 - RNA, 1341 nt, synthetic construct
  misc_feature 1..1341: note = derived and/or modified sequence opt2 from Etaracizumab_HeavyChain1
  source 1..1341: mol_type = other RNA
caggtccagctcgtcgagtccggcggcggcgtcgtccagcccggccgctccctccgcctctcctgcgccgcctccggcttcaccttctcctcctacgacatgtcctgggtccgccaggcccccggcaagggcctcgagtgggtcgccaaggtctcctccggcggcggctccacctactacctcgacaccgtccagggccgcttcaccatctcccgcgacaactccaagaacaccctctacctccagatgaactccctccgcgccgaggacaccgccgtctactactgcgcccgccacctccacggctccttcgcctcctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15560 - RNA, 642 nt, synthetic construct
  misc_feature 1..642: note = derived and/or modified sequence opt2 from Etaracizumab_LightChain1
  source 1..642: mol_type = other RNA
gagatcgtcctcacccagtcccccgccaccctctccctctcccccggcgagcgcgccaccctctcctgccaggcctcccagtccatctccaacttcctccactggtaccagcagcgccccggccaggccccccgcctcctcatccgctaccgctcccagtccatctccggcatccccgcccgcttctccggctccggctccggcaccgacttcaccctcaccatctcctccctcgagcccgaggacttcgccgtctactactgccagcagtccggctcctggcccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15561 - RNA, 1326 nt, synthetic construct
  misc_feature 1..1326: note = derived and/or modified sequence opt2 from Etrolizuab_HeavyChain1
  source 1..1326: mol_type = other RNA
gaggtccagctcgtcgagtccggcggcggcctcgtccagcccggcggctccctccgcctctcctgcgccgcctccggcttcttcatcaccaacaactactggggctgggtccgccaggcccccggcaagggcctcgagtgggtcggctacatctcctactccggctccacctcctacaacccctccctcaagtcccgcttcaccatctcccgcgacacctccaagaacaccttctacctccagaactccctccgcgccgaggacaccgccgtctactactgcgcccgcaccggctcctccggctacttcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 15562 - RNA, 1326 nt, synthetic construct
  misc_feature 1..1326: note = derived and/or modified sequence opt2 from Etrolizuab_HeavyChain2
  source 1..1326: mol_type = other RNA
gaggtccagctcgtcgagtccggcggcggcctcgtccagcccggcggctccctccgcctctcctgcgccgcctccggcttcttcatcaccaacaactactggggctgggtccgccaggcccccggcaagggcctcgagtgggtcggctacatctcctactccggctccacctcctacaacccctccaagctctcccgcttcaccatctcccgcgacacctccaagaacaccttctacctccagaactccctccgcgccgaggacaccgccgtctactactgcgcccgcaccggctcctccggctacttcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 15563 - RNA, 639 nt, synthetic construct
  misc_feature 1..639: note = derived and/or modified sequence opt2 from Etrolizuab_LightChain1
  source 1..639: mol_type = other RNA
gacatccagacccagtccccctcctccctctccgcctccgtcggcgaccgcgtcaccatcacctgccgcgcctccgagtccgtcgacgacctcctccactggtaccagcagaagcccggcaaggcccccaagctcctcatcaagtacgcctcccagtccatctccggcgtcccctcccgcttctccggctccggctccggcaccgacttcaccctcaccatctcctccctccagcccgaggacttcgccacctactactgccagcagggcaactccctccccaacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15564 - RNA, 1338 nt, synthetic construct
  misc_feature 1..1338: note = derived and/or modified sequence opt2 from Etrolizumab_HeavyChain1
  source 1..1338: mol_type = other RNA
gaggtccagctcgtcgagtccggcggcggcctcgtccagcccggcggctccctccgcctctcctgcgccgcctccggcttcttcatcaccaacaactactggggctgggtccgccaggcccccggcaagggcctcgagtgggtcggctacatctcctactccggctccacctcctacaacccctccctcaagtcccgcttcaccatctcccgcgacacctccaagaacaccttctacctccagatgaactccctccgcgccgaggacaccgccgtctactactgcgcccgcaccggctcctccggctacttcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15565 - RNA, 642 nt, synthetic construct
  misc_feature 1..642: note = derived and/or modified sequence opt2 from Etrolizumab_LightChain1
  source 1..642: mol_type = other RNA
gacatccagatgacccagtccccctcctccctctccgcctccgtcggcgaccgcgtcaccatcacctgccgcgcctccgagtccgtcgacgacctcctccactggtaccagcagaagcccggcaaggcccccaagctcctcatcaagtacgcctcccagtccatctccggcgtcccctcccgcttctccggctccggctccggcaccgacttcaccctcaccatctcctccctccagcccgaggacttcgccacctactactgccagcagggcaactccctccccaacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15566 - RNA, 1359 nt, synthetic construct
  misc_feature 1..1359: note = derived and/or modified sequence opt2 from Evinacumab_HeavyChain1
  source 1..1359: mol_type = other RNA
gaggtccagctcgtcgagtccggcggcggcgtcatccagcccggcggctccctccgcctctcctgcgccgcctccggcttcaccttcgacgactacgccatgaactgggtccgccagggccccggcaagggcctcgagtgggtctccgccatctccggcgacggcggctccacctactacgccgactccgtcaagggccgcttcaccatctcccgcgacaactccaagaactccctctacctccagatgaactccctccgcgccgaggacaccgccttcttctactgcgccaaggacctccgcaacaccatcttcggcgtcgtcatccccgacgccttcgacatctggggccagggcaccatggtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15567 - RNA, 642 nt, synthetic construct
  misc_feature 1..642: note = derived and/or modified sequence opt2 from Evinacumab_LightChain1
  source 1..642: mol_type = other RNA
gacatccagatgacccagtccccctccaccctctccgcctccgtcggcgaccgcgtcaccatcacctgccgcgcctcccagtccatccgctcctggctcgcctggtaccagcagaagcccggcaaggcccccaagctcctcatctacaaggcctcctccctcgagtccggcgtcccctcccgcttctccggctccggctccggcaccgagttcaccctcaccatctcctccctccagcccgacgacttcgccacctactactgccagcagtacaactcctactcctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15568 - RNA, 1323 nt, synthetic construct
  misc_feature 1..1323: note = derived and/or modified sequence opt2 from Evolocumab_HeavyChain1
  source 1..1323: mol_type = other RNA
gaggtccagctcgtccagtccggcgccgaggtcaagaagcccggcgcctccgtcaaggtctcctgcaaggcctccggctacaccctcacctcctacggcatctcctgggtccgccaggcccccggccagggcctcgagtggatgggctgggtctccttctacaacggcaacaccaactacgcccagaagctccagggccgcggcaccatgaccaccgacccctccacctccaccgcctacatggagctccgctccctccgctccgacgacaccgccgtctactactgcgcccgcggctacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15569 - RNA, 645 nt, synthetic construct
  misc_feature 1..645: note = derived and/or modified sequence opt2 from Evolocumab_LightChain1
  source 1..645: mol_type = other RNA
gagtccgccctcacccagcccgcctccgtctccggctcccccggccagtccatcaccatctcctgcaccggcacctcctccgacgtcggcggctacaactccgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgcaactcctacacctccacctccatggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15570 - RNA, 1353 nt, synthetic construct
  misc_feature 1..1353: note = derived and/or modified sequence opt2 from Exbivirumab_HeavyChain1
  source 1..1353: mol_type = other RNA
caggtccagctcgtcgagtccggcggcggcgtcgtccagcccggcggctccctccgcctctcctgcgccccctccggcttcgtcttccgctcctacggcatgcactgggtccgccagacccccggcaagggcctcgagtgggtctccctcatctggcacgacggctccaaccgcttctacgccgactccgtcaagggccgcttcaccatctcccgcgacaactccaagaacaccctctacctccagatgaactccctccgcgccgaggacaccgccatgtacttctgcgcccgcgagcgcctcatcgccgcccccgccgccttcgacctctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15571 - RNA, 642 nt, synthetic construct
  misc_feature 1..642: note = derived and/or modified sequence opt2 from Exbivirumab_LightChain1
  source 1..642: mol_type = other RNA
tcctacgtcctcacccagcccccctccgtctccgtcgcccccggcaagaccgcccgcatctcctgcggcggcaacaacatcggcaccaagaacgtccactggtaccagcagaagcccggccaggcccccgtcctcgtcgtctacgccgactccgaccgcccctccggcatccccgagcgcttctccggctccaactccggcaacaccgccaccctcaccatctcccgcgtcgaggccggcgacgaggccgactactactgccaggtctgggactccgtctcctaccacgtcgtcttcggcggcggcaccaccctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15572 - RNA, 1347 nt, synthetic construct
  misc_feature 1..1347: note = derived and/or modified sequence opt2 from Farletuzumab_HeavyChain1
  source 1..1347: mol_type = other RNA
gaggtccagctcgtcgagtccggcggcggcgtcgtccagcccggccgctccctccgcctctcctgctccgcctccggcttcaccttctccggctacggcctctcctgggtccgccaggcccccggcaagggcctcgagtgggtcgccatgatctcctccggcggctcctacacctactacgccgactccgtcaagggccgcttcgccatctcccgcgacaacgccaagaacaccctcttcctccagatggactccctccgccccgaggacaccggcgtctacttctgcgcccgccacggcgacgaccccgcctggttcgcctactggggccagggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15573 - RNA, 651 nt, synthetic construct
  misc_feature 1..651: note = derived and/or modified sequence opt2 from Farletuzumab_LightChain1
  source 1..651: mol_type = other RNA
gacatccagctcacccagtccccctcctccctctccgcctccgtcggcgaccgcgtcaccatcacctgctccgtctcctcctccatctcctccaacaacctccactggtaccagcagaagcccggcaaggcccccaagccctggatctacggcacctccaacctcgcctccggcgtcccctcccgcttctccggctccggctccggcaccgactacaccttcaccatctcctccctccagcccgaggacatcgccacctactactgccagcagtggtcctcctacccctacatgtacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15574 - RNA, 1338 nt, synthetic construct
  misc_feature 1..1338: note = derived and/or modified sequence opt2 from Fasinumab_HeavyChain1
  source 1..1338: mol_type = other RNA
caggtccagctcgtccagtccggcgccgaggtcaagaagcccggcgcctccgtcaaggtctcctgcaaggtctccggcttcaccctcaccgagctctccatccactgggtccgccaggcccccggcaagggcctcgagtggatgggcggcttcgaccccgaggacggcgagaccatctacgcccagaagttccagggccgcgtcaccatgaccgaggacacctccaccgacaccgcctacatggagctcacctccctccgctccgaggacaccgccgtctactactgctccaccatcttcggcgtcgtcaccaacttcgacaactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15575 - RNA, 642 nt, synthetic construct
  misc_feature 1..642: note = derived and/or modified sequence opt2 from Fasinumab_LightChain1
  source 1..642: mol_type = other RNA
gacatccagatgacccagtccccctcctccctctccgcctccgccggcgaccgcgtcaccatcacctgccgcgcctcccaggccatccgcaacgacctcggctggtaccagcagaagcccggcaaggcccccaagcgcctcatctacgccgccttcaacctccagtccggcgtcccctcccgcttctccggctccggctccggcaccgagttcaccctcaccatctcctccctccagcccgaggacctcgcctcctactactgccagcagtacaaccgctacccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15576 - RNA, 1350 nt, synthetic construct
  misc_feature 1..1350: note = derived and/or modified sequence opt2 from Fezakinumab_HeavyChain1
  source 1..1350: mol_type = other RNA
caggtccagctcgtccagtccggcgccgaggtcaagaagcccggcgcctccgtcaaggtctcctgcaaggcctccggctacaccttcaccaactactacatgcactgggtccgccaggcccccggccagggcctcgagtgggtcggctggatcaacccctacaccggctccgccttctacgcccagaagttccgcggccgcgtcaccatgacccgcgacacctccatctccaccgcctacatggagctctcccgcctccgctccgacgacaccgccgtctactactgcgcccgcgagcccgagaagttcgactccgacgactccgacgtctggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15577 - RNA, 651 nt, synthetic construct
  misc_feature 1..651: note = derived and/or modified sequence opt2 from Fezakinumab_LightChain1
  source 1..651: mol_type = other RNA
caggccgtcctcacccagcccccctccgtctccggcgcccccggccagcgcgtcaccatctcctgcaccggctcctcctccaacatcggcgccggctacggcgtccactggtaccagcagctccccggcaccgcccccaagctcctcatctacggcgactccaaccgcccctccggcgtccccgaccgcttctccggctccaagtccggcacctccgcctccctcgccatcaccggcctccaggccgaggacgaggccgactactactgccagtcctacgacaactccctctccggctacgtcttcggcggcggcacccagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15578 - RNA, 1347 nt, synthetic construct
  misc_feature 1..1347: note = derived and/or modified sequence opt2 from FG-3019_HeavyChain1
  source 1..1347: mol_type = other RNA
gagggccagctcgtccagtccggcggcggcctcgtccaccccggcggctccctccgcctctcctgcgccggctccggcttcaccttctcctcctacggcatgcactgggtccgccaggcccccggcaagggcctcgagtgggtctccggcatcggcaccggcggcggcacctactccaccgactccgtcaagggccgcttcaccatctcccgcgacaacgccaagaactccctctacctccagatgaactccctccgcgccgaggacatggccgtctactactgcgcccgcggcgactactacggctccggctccttcttcgactgctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15579 - RNA, 642 nt, synthetic construct
  misc_feature 1..642: note = derived and/or modified sequence opt2 from FG-3019_LightChain1
  source 1..642: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15580 - RNA, 1344 nt, synthetic construct
  misc_feature 1..1344: note = derived and/or modified sequence opt2 from Fibatuzumab_HeavyChain1
  source 1..1344: mol_type = other RNA
caggtccagctcgtccagtccggcgccgaggtcaagaagcccggcgcctccgtcaaggtctcctgcaaggcctccggctacaccttcaccggctactggatgaactgggtccgccaggcccccggccagggcctcgagtggatgggcgacatctaccccggctccggcaacaccaactacgacgagaagttccagggccgcgtcaccatgacccgcgacacctccatctccaccgcctacatggagctctcccgcctccgctccgacgacaccgccgtctactactgcgcccgcggcggctactacgaggacttcgactcctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15581 - RNA, 642 nt, synthetic construct
  misc_feature 1..642: note = derived and/or modified sequence opt2 from Fibatuzumab_LightChain1
  source 1..642: mol_type = other RNA
gacatccagatgacccagtccccctccttcctctccgcctccgtcggcgaccgcgtcaccatcacctgccgcgcctcccagggcatcatctcctacctcgcctggtaccagcagaagcccgagaaggcccccaagcgcctcatctacgccgcctcctccctccagtccggcgtcccctcccgcttctccggctccggctccggcaccgagttcaccctcaccatctcctccctccagcccgaggacttcgccacctactactgcggccagtacgccaactacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15582 - RNA, 1344 nt, synthetic construct
  misc_feature 1..1344: note = derived and/or modified sequence opt2 from Ficlatuzumab_HeavyChain1
  source 1..1344: mol_type = other RNA
caggtccagctcgtccagcccggcgccgaggtcaagaagcccggcacctccgtcaagctctcctgcaaggcctccggctacaccttcaccacctactggatgcactgggtccgccaggcccccggccagggcctcgagtggatcggcgagatcaaccccaccaacggccacaccaactacaaccagaagttccagggccgcgccaccctcaccgtcgacaagtccacctccaccgcctacatggagctctcctccctccgctccgaggacaccgccgtctactactgcgcccgcaactacgtcggctccatcttcgactactggggccagggcaccctcctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15583 - RNA, 1341 nt, synthetic construct
  misc_feature 1..1341: note = derived and/or modified sequence opt2 from Ficlatuzumab_HeavyChain
  source 1..1341: mol_type = other RNA
gtccagctcgtccagcccggcgccgaggtcaagaagcccggcacctccgtcaagctctcctgcaaggcctccggctacaccttcaccacctactggatgcactgggtccgccaggcccccggccagggcctcgagtggatcggcgagatcaaccccaccaacggccacaccaactacaaccagaagttccagggccgcgccaccctcaccgtcgacaagtccacctccaccgcctacatggagctctcctccctccgctccgaggacaccgccgtctactactgcgcccgcaactacgtcggctccatcttcgactactggggccagggcaccctcctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15584 - RNA, 642 nt, synthetic construct
  misc_feature 1..642: note = derived and/or modified sequence opt2 from Ficlatuzumab_LightChain1
  source 1..642: mol_type = other RNA
gacatcgtcatgacccagtcccccgactccctcgccatgtccctcggcgagcgcgtcaccctcaactgcaaggcctccgagaacgtcgtctcctacgtctcctggtaccagcagaagcccggccagtcccccaagctcctcatctacggcgcctccaaccgcgagtccggcgtccccgaccgcttctccggctccggctccgccaccgacttcaccctcaccatctcctccgtccaggccgaggacgtcgccgactaccactgcggccagtcctacaactacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15585 - RNA, 1350 nt, synthetic construct
  misc_feature 1..1350: note = derived and/or modified sequence opt2 from Figitumumab_HeavyChain1
  source 1..1350: mol_type = other RNA
gaggtccagctcctcgagtccggcggcggcctcgtccagcccggcggctccctccgcctctcctgcaccgcctccggcttcaccttctcctcctacgccatgaactgggtccgccaggcccccggcaagggcctcgagtgggtctccgccatctccggctccggcggcaccaccttctacgccgactccgtcaagggccgcttcaccatctcccgcgacaactcccgcaccaccctctacctccagatgaactccctccgcgccgaggacaccgccgtctactactgcgccaaggacctcggctggtccgactcctactactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15586 - RNA, 642 nt, synthetic construct
  misc_feature 1..642: note = derived and/or modified sequence opt2 from Figitumumab_LightChain1
  source 1..642: mol_type = other RNA
gacatccagatgacccagttcccctcctccctctccgcctccgtcggcgaccgcgtcaccatcacctgccgcgcctcccagggcatccgcaacgacctcggctggtaccagcagaagcccggcaaggcccccaagcgcctcatctacgccgcctcccgcctccaccgcggcgtcccctcccgcttctccggctccggctccggcaccgagttcaccctcaccatctcctccctccagcccgaggacttcgccacctactactgcctccagcacaactcctacccctgctccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15587 - RNA, 1359 nt, synthetic construct
  misc_feature 1..1359: note = derived and/or modified sequence opt2 from Firivumab_HeavyChain1
  source 1..1359: mol_type = other RNA
caggtccagctcgtccagtccggcgccgaggtcaagatgcccggctcctccgtcaaggtctcctgcaagacctccggcgtcttcttctcctcccacgccatctcctgggtccgccaggcccccggccagggcctcgagtggatgggcggcatctcccccatgttcggcaccacccactacgcccagaagttccagggccgcgtcaccatcaccgccgaccagtccaccaccaccgcctacatggagctcacctccctcacctccgaggacaccgccgtctactactgcgcccgcgacggcgccggctcctactaccccctcaactggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 15588 - RNA, 642 nt, synthetic construct
  misc_feature 1..642: note = derived and/or modified sequence opt2 from Firivumab_LightChain1
  source 1..642: mol_type = other RNA
gagatcgtcctcacccagtcccccgccaccctctccctctcccccggcgagcgcgccaccctctcctgccgcgcctccgagaacatctggaacaacctcgcctggtaccagcagaagcccggccaggccccccgcctcctcatctccggcgcctccaccggcgccaccggcgtcccctcccgcttccgcggctccggctcccgcaccgagttcaccctcaccatctcctccctccagtccgaggacttcgccatctacttctgccagcagtacaactcctggccccgcaccttcggccccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15589 - RNA, 1347 nt, synthetic construct
  misc_feature 1..1347: note = derived and/or modified sequence opt2 from Flanvotumab_HeavyChain1
  source 1..1347: mol_type = other RNA
caggtccagctcgtccagtccggctccgagctcaagaagcccggcgcctccgtcaagatctcctgcaaggcctccggctacaccttcacctcctacgccatgaactgggtccgccaggcccccggccagggcctcgagtccatgggctggatcaacaccaacaccggcaaccccacctacgcccagggcttcaccggccgcttcgtcttctccatggacacctccgtctccaccgcctacctccagatctcctccctcaaggccgaggacaccgccatctactactgcgccccccgctactcctcctcctggtacctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15590 - RNA, 645 nt, synthetic construct
  misc_feature 1..645: note = derived and/or modified sequence opt2 from Flanvotumab_LightChain1
  source 1..645: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggctcatgtacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15591 - RNA, 1362 nt, synthetic construct
  misc_feature 1..1362: note = derived and/or modified sequence opt2 from Fletikumab_HeavyChain1
  source 1..1362: mol_type = other RNA
caggtccagctcgtccagtccggcgccgaggtcaagcgccccggcgcctccgtcaaggtctcctgcaaggcctccggctacaccttcaccaacgacatcatccactgggtccgccaggcccccggccagcgcctcgagtggatgggctggatcaacgccggctacggcaacacccagtactcccagaacttccaggaccgcgtctccatcacccgcgacacctccgcctccaccgcctacatggagctcatctccctccgctccgaggacaccgccgtctactactgcgcccgcgagcccctctggttcggcgagtcctccccccacgactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15592 - RNA, 642 nt, synthetic construct
  misc_feature 1..642: note = derived and/or modified sequence opt2 from Fletikumab_LightChain1
  source 1..642: mol_type = other RNA
gccatccagctcacccagtccccctcctccctctccgcctccgtcggcgaccgcgtcaccatcacctgccgcgcctcccagggcatctcctccgccctcgcctggtaccagcagaagcccggcaaggcccccaagctcctcatctacgacgcctcctccctcgagtccggcgtcccctcccgcttctccggctccggctccggcaccgacttcaccctcaccatctcctccctccagcccgaggacttcgccacctactactgccagcagttcaactcctaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15593 - RNA, 1341 nt, synthetic construct
  misc_feature 1..1341: note = derived and/or modified sequence opt2 from Fontolizumab_HeavyChain1
  source 1..1341: mol_type = other RNA
caggtccagctcgtccagtccggcgccgagctcaagaagcccggctcctccgtcaaggtctcctgcaaggcctccggctacatcttcacctcctcctggatcaactgggtcaagcaggcccccggccagggcctcgagtggatcggccgcatcgacccctccgacggcgaggtccactacaaccaggacttcaaggacaaggccaccctcaccgtcgacaagtccaccaacaccgcctacatggagctctcctccctccgctccgaggacaccgccgtctactactgcgcccgcggcttcctcccctggttcgccgactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15594 - RNA, 642 nt, synthetic construct
  misc_feature 1..642: note = derived and/or modified sequence opt2 from Fontolizumab_LightChain1
  source 1..642: mol_type = other RNA
gacatccagatgacccagtccccctccaccctctccgcctccgtcggcgaccgcgtcaccatcacctgcaaggcctccgagaacgtcgacacctacgtctcctggtaccagcagaagcccggcaaggcccccaagctcctcatctacggcgcctccaaccgctacaccggcgtcccctcccgcttctccggctccggctccggcaccgacttcaccctcaccatctcctccctccagcccgacgacttcgccacctactactgcggccagtcctacaactaccccttcaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15595 - RNA, 1344 nt, synthetic construct
  misc_feature 1..1344: note = derived and/or modified sequence opt2 from Foralumab_HeavyChain1
  source 1..1344: mol_type = other RNA
caggtccagctcgtcgagtccggcggcggcgtcgtccagcccggccgctccctccgcctctcctgcgccgcctccggcttcaagttctccggctacggcatgcactgggtccgccaggcccccggcaagggcctcgagtgggtcgccgtcatctggtacgacggctccaagaagtactacgtcgactccgtcaagggccgcttcaccatctcccgcgacaactccaagaacaccctctacctccagatgaactccctccgcgccgaggacaccgccgtctactactgcgcccgccagatgggctactggcacttcgacctctggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgaggccgagggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15596 - RNA, 645 nt, synthetic construct
  misc_feature 1..645: note = derived and/or modified sequence opt2 from Foralumab_LightChain1
  source 1..645: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15597 - RNA, 1344 nt, synthetic construct
  misc_feature 1..1344: note = derived and/or modified sequence opt2 from Foravirumab_HeavyChain1
  source 1..1344: mol_type = other RNA
caggtccagctcgtcgagtccggcggcggcgccgtccagcccggccgctccctccgcctctcctgcgccgcctccggcttcaccttctcctcctacggcatgcactgggtccgccaggcccccggcaagggcctcgagtgggtcgccgtcatcctctacgacggctccgacaagttctacgccgactccgtcaagggccgcttcaccatctcccgcgacaactccaagaacaccctctacctccagatgaactccctccgcgccgaggacaccgccgtctactactgcgccaaggtcgccgtcgccggcacccacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15598 - RNA, 1344 nt, synthetic construct
  misc_feature 1..1344: note = derived and/or modified sequence opt2 from Foravirumab_HeavyChain
  source 1..1344: mol_type = other RNA
gaggtccagctcgtcgagtccggcggcggcgccgtccagcccggccgctccctccgcctctcctgcgccgcctccggcttcaccttctcctcctacggcatgcactgggtccgccaggcccccggcaagggcctcgagtgggtcgccgtcatcctctacgacggctccgacaagttctacgccgactccgtcaagggccgcttcaccatctcccgcgacaactccaagaacaccctctacctccagatgaactccctccgcgccgaggacaccgccgtctactactgcgccaaggtcgccgtcgccggcacccacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15599 - RNA, 642 nt, synthetic construct
  misc_feature 1..642: note = derived and/or modified sequence opt2 from Foravirumab_LightChain1
  source 1..642: mol_type = other RNA
gacatccagatgacccagtccccctcctccctctccgcctccgtcggcgaccgcgtcaccatcacctgccgcgcctcccagggcatccgcaacgacctcggctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagctcaactcctacccccccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15600 - RNA, 1341 nt, synthetic construct
  misc_feature 1..1341: note = derived and/or modified sequence opt2 from Fresolimumab_HeavyChain1
  source 1..1341: mol_type = other RNA
caggtccagctcgtccagtccggcgccgaggtcaagaagcccggctcctccgtcaaggtctcctgcaaggcctccggctacaccttctcctccaacgtcatctcctgggtccgccaggcccccggccagggcctcgagtggatgggcggcgtcatccccatcgtcgacatcgccaactacgcccagcgcttcaagggccgcgtcaccatcaccgccgacgagtccacctccaccacctacatggagctctcctccctccgctccgaggacaccgccgtctactactgcgcctccaccctcggcctcgtcctcgacgccatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15601 - RNA, 645 nt, synthetic construct
  misc_feature 1..645: note = derived and/or modified sequence opt2 from Fresolimumab_LightChain1
  source 1..645: mol_type = other RNA
gagaccgtcctcacccagtcccccggcaccctctccctctcccccggcgagcgcgccaccctctcctgccgcgcctcccagtccctcggctcctcctacctcgcctggtaccagcagaagcccggccaggccccccgcctcctcatctacggcgcctcctcccgcgcccccggcatccccgaccgcttctccggctccggctccggcaccgacttcaccctcaccatctcccgcctcgagcccgaggacttcgccgtctactactgccagcagtacgccgactcccccatcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15602 - RNA, 1347 nt, synthetic construct
  misc_feature 1..1347: note = derived and/or modified sequence opt2 from Fulranumab_HeavyChain1
  source 1..1347: mol_type = other RNA
gaggtccagctcgtcgagtccggcggcggcctcgtccagcccggcggctccctccgcctctcctgcgccgcctccggcttcaccctccgctcctactccatgaactgggtccgccaggcccccggcaagggcctcgagtgggtctcctacatctcccgctcctcccacaccatcttctacgccgactccgtcaagggccgcttcaccatctcccgcgacaacgccaagaactccctctacctccagatggactccctccgcgacgaggacaccgccatgtactactgcgcccgcgtctactcctccggctggcacgtctccgactacttcgactactggggccagggcatcctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15603 - RNA, 642 nt, synthetic construct; identical to SEQ ID NO: 15592
  misc_feature 1..642: note = derived and/or modified sequence opt2 from Fulranumab_LightChain1
  source 1..642: mol_type = other RNA

SEQ ID NO: 15604 - RNA, 1356 nt, synthetic construct
  misc_feature 1..1356: note = derived and/or modified sequence opt2 from Futuximab_HeavyChain1
  source 1..1356: mol_type = other RNA
gaggtccagctccagcagcccggctccgagctcgtccgccccggcgcctccgtcaagctctcctgcaaggcctccggctacaccttcacctcctactggatgcactgggtcaagcagcgccccggccagggcctcgagtggatcggcaacatctaccccggctcccgctccaccaactacgacgagaagttcaagtccaaggccaccctcaccgtcgacacctcctcctccaccgcctacatgcagctctcctccctcacctccgaggactccgccgtctactactgcacccgcaacggcgactactacgtctcctccggcgacgccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15605 - RNA, 642 nt, synthetic construct
  misc_feature 1..642: note = derived and/or modified sequence opt2 from Futuximab_LightChain1
  source 1..642: mol_type = other RNA
gacatccagatgacccagaccacctcctccctctccgcctccctcggcgaccgcgtcaccatctcctgccgcacctcccaggacatcggcaactacctcaactggtaccagcagaagcccgacggcaccgtcaagctcctcatctactacacctcccgcctccactccggcgtcccctcccgcttctccggctccggctccggcaccgacttctccctcaccatcaacaacgtcgagcaggaggacgtcgccacctacttctgccagcactacaacaccgtcccccccaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15606 - RNA, 1335 nt, synthetic construct
  misc_feature 1..1335: note = derived and/or modified sequence opt2 from Galcanezumab_HeavyChain1
  source 1..1335: mol_type = other RNA
caggtccagctcgtccagtccggcgccgaggtcaagaagcccggctcctccgtcaaggtctcctgcaaggcctccggctacaccttcggcaactactggatgcagtgggtccgccaggcccccggccagggcctcgagtggatgggcgccatctacgagggcaccggcaagaccgtctacatccagaagttcgccgaccgcgtcaccatcaccgccgacaagtccacctccaccgcctacatggagctctcctccctccgctccgaggacaccgccgtctactactgcgcccgcctctccgactacgtctccggcttcggctactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgaggccgccggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15607 - RNA, 642 nt, synthetic construct
  misc_feature 1..642: note = derived and/or modified sequence opt2 from Galcanezumab_LightChain1
  source 1..642: mol_type = other RNA
gacatccagatgacccagtccccctcctccctctccgcctccgtcggcgaccgcgtcaccatcacctgccgcgcctccaaggacatctccaagtacctcaactggtaccagcagaagcccggcaaggcccccaagctcctcatctactacacctccggctaccactccggcgtcccctcccgcttctccggctccggctccggcaccgacttcaccctcaccatctcctccctccagcccgaggacttcgccacctactactgccagcagggcgacgccctcccccccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15608 - RNA, 1371 nt, synthetic construct
  misc_feature 1..1371: note = derived and/or modified sequence opt2 from Galiximab_HeavyChain1
  source 1..1371: mol_type = other RNA
caggtccagctccaggagtccggccccggcctcgtcaagccctccgagaccctctccctcacctgcgccgtctccggcggctccatctccggcggctacggctggggctggatccgccagccccccggcaagggcctcgagtggatcggctccttctactcctcctccggcaacacctactacaacccctccctcaagtcccaggtcaccatctccaccgacacctccaagaaccagttctccctcaagctcaactccatgaccgccgccgacaccgccgtctactactgcgtccgcgaccgcctcttctccgtcgtcggcatggtctacaacaactggttcgacgtctggggccccggcgtcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15609 - RNA, 648 nt, synthetic construct
  misc_feature 1..648: note = derived and/or modified sequence opt2 from Galiximab_LightChain1
  source 1..648: mol_type = other RNA
gagtccgccctcacccagcccccctccgtctccggcgcccccggccagaaggtcaccatctcctgcaccggctccacctccaacatcggcggctacgacctccactggtaccagcagctccccggcaccgcccccaagctcctcatctacgacatcaacaagcgcccctccggcatctccgaccgcttctccggctccaagtccggcaccgccgcctccctcgccatcaccggcctccagaccgaggacgaggccgactactactgccagtcctacgactcctccctcaacgcccaggtcttcggcggcggcacccgcctcaccgtcctcggccagcccaaggccgcccccaccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15610 - RNA, 1347 nt, synthetic construct
  misc_feature 1..1347: note = derived and/or modified sequence opt2 from Ganitumab_HeavyChain1
  source 1..1347: mol_type = other RNA
caggtccagctccaggagtccggccccggcctcgtcaagccctccggcaccctctccctcacctgcgccgtctccggcggctccatctcctcctccaactggtggtcctgggtccgccagccccccggcaagggcctcgagtggatcggcgagatctaccactccggctccaccaactacaacccctccctcaagtcccgcgtcaccatctccgtcgacaagtccaagaaccagttctccctcaagctctcctccgtcaccgccgccgacaccgccgtctactactgcgcccgctggaccggccgcaccgacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15611 - RNA, 657 nt, synthetic construct
  misc_feature 1..657: note = derived and/or modified sequence opt2 from Ganitumab_LightChain1
  source 1..657: mol_type = other RNA
gacgtcgtcatgacccagtcccccctctccctccccgtcacccccggcgagcccgcctccatctcctgccgctcctcccagtccctcctccactccaacggctacaactacctcgactggtacctccagaagcccggccagtccccccagctcctcatctacctcggctccaaccgcgcctccggcgtccccgaccgcttctccggctccggctccggcaccgacttcaccctcaagatctcccgcgtcgaggccgaggacgtcggcgtctactactgcatgcagggcacccactggcccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15612 - RNA, 1368 nt, synthetic construct
  misc_feature 1..1368: note = derived and/or modified sequence opt2 from Gantenerumab_HeavyChain1
  source 1..1368: mol_type = other RNA
caggtcgagctcgtcgagtccggcggcggcctcgtccagcccggcggctccctccgcctctcctgcgccgcctccggcttcaccttctcctcctacgccatgtcctgggtccgccaggcccccggcaagggcctcgagtgggtctccgccatcaacgcctccggcacccgcacctactacgccgactccgtcaagggccgcttcaccatctcccgcgacaactccaagaacaccctctacctccagatgaactccctccgcgccgaggacaccgccgtctactactgcgcccgcggcaagggcaacacccacaagccctacggctacgtccgctacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15613 - RNA, 645 nt, synthetic construct
  misc_feature 1..645: note = derived and/or modified sequence opt2 from Gantenerumab_LightChain1
  source 1..645: mol_type = other RNA
gacatcgtcctcacccagtcccccgccaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcgtccccgcccgcttctccggctccggctccggcaccgacttcaccctcaccatctcctccctcgagcccgaggacttcgccacctactactgcctccagatctacaacatgcccatcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15614 - RNA, 348 nt, synthetic construct
  misc_feature 1..348: note = derived and/or modified sequence opt2 from Gemtuzumab_HeavyChain1
  source 1..348: mol_type = other RNA
caggtccagctccagcagtccggcgccgagctcgccaagcccggcgcctccgtcaagatgtcctgcaaggcctccggctacaccttcacctcctaccgcatgcactgggtcaagcagcgccccggccagggcctcgagtggatcggctacatcaacccctccaccggctacaccgagtacaaccagaagttcaaggacaaggccaccctcaccgccgacaagtcctcctccaccgcctacatgcagctctcctccctcaccttcgaggactccgccgtctactactgcgcccgcggcggcggcgtcttcgactactggggccagggcaccaccctcaccgtctcctcc

SEQ ID NO: 15615 - RNA, 351 nt, synthetic construct
  misc_feature 1..351: note = derived and/or modified sequence opt2 from Gemtuzumab_HeavyChain2
  source 1..351: mol_type = other RNA
caggtccagctcgtccagtccggcgccgaggtcaagaagcccggctcctccgtcaaggtctcctgcaaggcctccggcggcaccttctcccgctccgccatcatctgggtccgccaggcccccggccagggcctcgagtggatgggcggcatcgtccccatgttcggcccccccaactacgcccagaagttccagggccgcgtcaccatcaccgccgacgagtccaccaacaccgcctacatggagctctcctccctccgctccgaggacaccgccttctacttctgcgccggcggctacggcatctactcccccgaggagtacaacggcggcctcgtcaccgtctcctcc

SEQ ID NO: 15616 - RNA, 321 nt, synthetic construct
  misc_feature 1..321: note = derived and/or modified sequence opt2 from Gemtuzumab_LightChain2
  source 1..321: mol_type = other RNA
gacatccagatgacccagtccccctccaccctctccgcctccgtcggcgaccgcgtcaccatcacctgccgcgcctcccagtccatcaacacctggctcgcctggtaccagcagaagcccggcaaggcccccaagctcctcatgtacaaggcctcctccctcgagtccggcgtcccctcccgcttcatcggctccggctccggcaccgagttcaccctcaccatctcctccctccagcccgacgacttcgccacctactactgccagcagtacaactccgactccaagatgttcggccagggcaccaaggtcgaggtcaag

SEQ ID NO: 15617 - RNA, 318 nt, synthetic construct
  misc_feature 1..318: note = derived and/or modified sequence opt2 from Gemtuzumab_ozogamicin_LightChain1
  source 1..318: mol_type = other RNA
cagatcgtcctcacccagtcccccgccatcatgtccgcctcccccggcgagaaggtcaccatcacctgctccgcctcctcctccatctcctacatgcactggttccagcagaagcccggcacctcccccaagctctggatctacaccacctccaacctcgcctccggcgtccccgcccgcttctccggctccggctccggcacctcctactccctcaccatctcccgcatggaggccgaggacgccgccacctactactgccaccagcgctccacctaccccctcaccttcggctccggcaccaagctcgagctcaag

SEQ ID NO: 15618 - RNA, 1335 nt, synthetic construct
  misc_feature 1..1335: note = derived and/or modified sequence opt2 from Gevokizumab_HeavyChain1
  source 1..1335: mol_type = other RNA
caggtccagctccaggagtccggccccggcctcgtcaagccctcccagaccctctccctcacctgctccttctccggcttctccctctccacctccggcatgggcgtcggctggatccgccagccctccggcaagggcctcgagtggctcgcccacatctggtgggacggcgacgagtcctacaacccctccctcaagtcccgcctcaccatctccaaggacacctccaagaaccaggtctccctcaagatcacctccgtcaccgccgccgacaccgccgtctacttctgcgcccgcaaccgctacgaccccccctggttcgtcgactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcacctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15619 - RNA, 642 nt, synthetic construct
  misc_feature 1..642: note = derived and/or modified sequence opt2 from Gevokizumab_LightChain1
  source 1..642: mol_type = other RNA
gacatccagatgacccagtccacctcctccctctccgcctccgtcggcgaccgcgtcaccatcacctgccgcgcctcccaggacatctccaactacctctcctggtaccagcagaagcccggcaaggccgtcaagctcctcatctactacacctccaagctccactccggcgtcccctcccgcttctccggctccggctccggcaccgactacaccctcaccatctcctccctccagcaggaggacttcgccacctacttctgcctccagggcaagatgctcccctggaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15620 - RNA, 1347 nt, synthetic construct
  misc_feature 1..1347: note = derived and/or modified sequence opt2 from Girentuximab_HeavyChain1
  source 1..1347: mol_type = other RNA
gacgtcaagctcgtcgagtccggcggcggcctcgtcaagctcggcggctccctcaagctctcctgcgccgcctccggcttcaccttctccaactactacatgtcctgggtccgccagacccccgagaagcgcctcgagctcgtcgccgccatcaactccgacggcggcatcacctactacctcgacaccgtcaagggccgcttcaccatctcccgcgacaacgccaagaacaccctctacctccagatgtcctccctcaagtccgaggacaccgccctcttctactgcgcccgccaccgctccggctacttctccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15621 - RNA, 642 nt, synthetic construct
  misc_feature 1..642: note = derived and/or modified sequence opt2 from Girentuximab_LightChain1
  source 1..642: mol_type = other RNA
gacatcgtcatgacccagtcccagcgcttcatgtccaccaccgtcggcgaccgcgtctccatcacctgcaaggcctcccagaacgtcgtctccgccgtcgcctggtaccagcagaagcccggccagtcccccaagctcctcatctactccgcctccaaccgctacaccggcgtccccgaccgcttcaccggctccggctccggcaccgacttcaccctcaccatctccaacatgcagtccgaggacctcgccgacttcttctgccagcagtactccaactacccctggaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15622 - RNA, 1335 nt, synthetic construct
  misc_feature 1..1335: note = derived and/or modified sequence opt2 from Glembatumumab_HeavyChain1
  source 1..1335: mol_type = other RNA
caggtccagctccaggagtccggccccggcctcgtcaagccctcccagaccctctccctcacctgcaccgtctccggcggctccatctcctccttcaactactactggtcctggatccgccaccaccccggcaagggcctcgagtggatcggctacatctactactccggctccacctactccaacccctccctcaagtcccgcgtcaccatctccgtcgacacctccaagaaccagttctccctcaccctctcctccgtcaccgccgccgacaccgccgtctactactgcgcccgcggctacaactggaactacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15623 - RNA, 645 nt, synthetic construct
  misc_feature 1..645: note = derived and/or modified sequence opt2 from Glembatumumab_LightChain1
  source 1..645: mol_type = other RNA
gagatcgtcatgacccagtcccccgccaccctctccgtctcccccggcgagcgcgccaccctctcctgccgcgcctcccagtccgtcgacaacaacctcgtctggtaccagcagaagcccggccaggccccccgcctcctcatctacggcgcctccacccgcgccaccggcatccccgcccgcttctccggctccggctccggcaccgagttcaccctcaccatctcctccctccagtccgaggacttcgccgtctactactgccagcagtacaacaactggcccccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15624 - RNA, 1332 nt, synthetic construct
  misc_feature 1..1332: note = derived and/or modified sequence opt2 from Goilixiab_HeavyChain1
  source 1..1332: mol_type = other RNA
gaggtccagctcgtcgagtccggcggcggcctcgccaagcccggcggctccctccgcctctcctgcgccgcctccggcttccgcttcaccttcaacaactactacgactgggtccgccaggcccccggccagggcctcgagtgggtctcccgcatctcctcctccggcgaccccacctggtacgccgactccgtcaagggccgcttcaccatctcccgcgagaacgccaagaacaccctcttcctccagaactccctccgcgccgaggacaccgccgtctactactgcgcctccctcaccaccggctccgactcctggggccagggcgtcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 15625 - RNA, 639 nt, synthetic construct
  misc_feature 1..639: note = derived and/or modified sequence opt2 from Goilixiab_LightChain1
  source 1..639: mol_type = other RNA
gacatccagacccagtccccctcctccctctccgcctccgtcggcgaccgcgtcaccatcacctgccgcgcctcccaggacatccgctactacctcaactggtaccagcagaagcccggcaaggcccccaagctcctcatctacgtcgcctcctccctccagtccggcgtcccctcccgcttctccggctccggctccggcaccgagttcaccctcaccgtctcctccctccagcccgaggacttcgccacctactactgcctccaggtctactccaccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15626 - RNA, 1338 nt, synthetic construct
  misc_feature 1..1338: note = derived and/or modified sequence opt2 from Guselkumab_HeavyChain1
  source 1..1338: mol_type = other RNA
gaggtccagctcgtccagtccggcgccgaggtcaagaagcccggcgagtccctcaagatctcctgcaagggctccggctactccttctccaactactggatcggctgggtccgccagatgcccggcaagggcctcgagtggatgggcatcatcgacccctccaactcctacacccgctactccccctccttccagggccaggtcaccatctccgccgacaagtccatctccaccgcctacctccagtggtcctccctcaaggcctccgacaccgccatgtactactgcgcccgctggtactacaagcccttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15627 - RNA, 651 nt, synthetic construct
  misc_feature 1..651: note = derived and/or modified sequence opt2 from Guselkumab_LightChain1
  source 1..651: mol_type = other RNA
cagtccgtcctcacccagcccccctccgtctccggcgcccccggccagcgcgtcaccatctcctgcaccggctcctcctccaacatcggctccggctacgacgtccactggtaccagcagctccccggcaccgcccccaagctcctcatctacggcaactccaagcgcccctccggcgtccccgaccgcttctccggctccaagtccggcacctccgcctccctcgccatcaccggcctccagtccgaggacgaggccgactactactgcgcctcctggaccgacggcctctccctcgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15628 - RNA, 360 nt, synthetic construct
  misc_feature 1..360: note = derived and/or modified sequence opt2 from HuMab-001_HeavyChain_VDJ-Region
  source 1..360: mol_type = other RNA
caggtccagctccagcagtggggcgccggcctcctcaagccctccgagaccctctccctcacctgcgccgtctacggcggctccttctccggctactactggaactggatccgccagccccccggcaagggcctcgagtggatcggcgagatcaaccactccggctccaccaactacaacccctccctcaagtcccgcgtcaccatctccgtcgacacctccaagaaccagttctccctcaagctctcctccgtcaccgccgccgacaccgccgtctactactgcgcccgcggcaactacggctccggctactactacttcgacctctggggccgcggcacccaggtcaccgtctcctcc

SEQ ID NO: 15629 - RNA, 321 nt, synthetic construct
  misc_feature 1..321: note = derived and/or modified sequence opt2 from HuMab-001_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatcttcgccgcctcctccctccagtccggcgtcccctcccgcttctccggctccggctccggcaccgacttcaccctcaccatctcctccctccagcccgaggacttcgccacctactactgccagcagtacatctccttccccatcaccttcggccagggcacccgcctcgagatcaag

SEQ ID NO: 15630 - RNA, 366 nt, synthetic construct
  misc_feature 1..366: note = derived and/or modified sequence opt2 from HuMab-005_HeavyChain_gamma-Chain_VDJ-Region
  source 1..366: mol_type = other RNA
gaggtccagctcgtccagtccggcgccgaggtcaagaagcccggcgagtccctcaagatctcctgcaaggcctccggctactccttccacttctactggatcggctgggtccgccagatgcccggcaagggcctcgagtggatgggctccatctaccccggcgactccgacacccgctaccgcccctccttccagggccaggtcaccatctccgccgacaagtccatctccaccgcctacctccagtggacctccctcaaggcctccgacaccgccatctactactgcgcccgccagcgcggcgactactactacttctacggcatggacgtctggggccagggcaccaccgtcaccgtctcctcc

SEQ ID NO: 15631 - RNA, 321 nt, synthetic construct
  misc_feature 1..321: note = derived and/or modified sequence opt2 from HuMab-005_LightChain_VJ-Region
  source 1..321: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggtcccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccctcaccttcggcggcggcaccaaggtcgagatcaag

SEQ ID NO: 15632 - RNA, 357 nt, synthetic construct
  misc_feature 1..357: note = derived and/or modified sequence opt2 from HuMab-006_HeavyChain_VDJ-Region
  source 1..357: mol_type = other RNA
gaggtccagctcctcgagtccggcggcggcctcgtccagcccggcggctccctccgcctctcctgcgccgcctccggcttcaccttctccaactacgccctcatctgggtccgccaggcccccggcaagggcctcgagtgggtctccatcatccgcggcggcgccggctccacctactacgccgactccgtcaagggccgcttcaccatctcccgcgacaactccaagaacaccctctacctccagatgaactccctccgcgccgaggacaccgccgtctactactgcgccaaggcccgcatctggggccccctcttcgactactggggccagggcaccctcgtcaccgtctcctcc

SEQ ID NO: 15633 - RNA, 324 nt, synthetic construct
  misc_feature 1..324: note = derived and/or modified sequence opt2 from HuMab-006_LightChain_VJ-Region
  source 1..324: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccctcaccttcggcggcggcaccaaggtcgagatcaag

SEQ ID NO: 15634 - RNA, 360 nt, synthetic construct
  misc_feature 1..360: note = derived and/or modified sequence opt2 from HuMab-019_HeavyChain_VDJ-Region
  source 1..360: mol_type = other RNA
caggtccagctccagcagtggggcgccggcctcctcaagccctccgagaccctctccctcacctgcgccgtctacggcggctccttctccgactactactggaactggatccgccagccccccggcaagggcctcgagtggatcggcgagatccaccacgtcggctccaccaactacaacccctccctcaagtcccgcgtcaccatctccgtcgacacctccaagtcccagttctccctcaagctctcctccgtcaccgccgccgacaccgccgtctactactgcgcccgcggctactacgactccggcgtctactacttcgactactgggcccagggcaccctcgtcaccgtctcctcc

SEQ ID NO: 15635 - RNA, 360 nt, synthetic construct
  misc_feature 1..360: note = derived and/or modified sequence opt2 from HuMab-021_HeavyChain_VDJ-Region
  source 1..360: mol_type = other RNA
caggtccagctccagcagtggggcgccggcctcctcaagccctccgagaccctctccctcacctgcgccgtctacggcggctccttctccgactactactggaactggatccgccagccccccggcaagggcctcgagtggatcggcgagatccaccactccggctccaccaactacaacccctccctcaagtcccgcgtcaccatctccgtcgacacctccaagaaccagttctccctcaagctctcctccgtcaccgccgccgacaccgccgtctactactgcgcccgcggctactacgcctccggcgtctactacttcgactactggggccagggcaccctcgtcaccgtctcctcc

SEQ ID NO: 15636 - RNA, 321 nt, synthetic construct
  misc_feature 1..321: note = derived and/or modified sequence opt2 from HuMab-021_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctaccccatcaccttcggccagggcacccgcctcgagatcaag

SEQ ID NO: 15637 - RNA, 360 nt, synthetic construct
  misc_feature 1..360: note = derived and/or modified sequence opt2 from HuMab-025_HeavyChain_VDJ-Region
  source 1..360: mol_type = other RNA
caggtccagctccagcagtggggcgccggcctcctcaagccctccgagaccctctccctcacctgcgccgtctacggcggctccttctccgactactactggaactggatccgccagccccccggcaagggcctcgagtggatcggcgagatccaccactccggctccaccaactacaacccctccctcaagtcccgcgtcaccatctccgtcgacacctccaagaaccagttctccctcaagctctcctccgtcaccgccgccgacaccgccgtctactactgcgcccgcggctactacgactccggcgtctactacttcgactactgggcccagggcaccctcgtcaccgtctcctcc

SEQ ID NO: 15638 - RNA, 321 nt, synthetic construct
  misc_feature 1..321: note = derived and/or modified sequence opt2 from HuMab-025_LightChain_VJ-Region
  source 1..321: mol_type = other RNA
gacatccagatgacccagtccccctcctccctctccgcctccgtcggcgaccgcgtcaccatcacctgccgcgcctcccagggcatctcccgctggctcgcctggtaccagcagaagcccgagaaggcccccaagtccctcatctacgccgcctcctccctccgctccggcgtcccctcccgcttctccggctccggctccggcaccgacttcaccctcaccatctcctccctccagcccgaggacttcgccacctactactgccagcagtacaactcctaccccatcaccttcggccagggcacccgcctcgagatcaag

SEQ ID NO: 15639 - RNA, 360 nt, synthetic construct
  misc_feature 1..360: note = derived and/or modified sequence opt2 from HuMab-027_HeavyChain_VDJ-Region
  source 1..360: mol_type = other RNA
caggtccagctccagcagtggggcgccggcctcctcaagccctccgagaccctctccctcacctgcgccgtctacggcggctccttctccgactacttctggaactggatccgccagccccccggcaagggcctcgagtggatcggcgagatccaccactccggctccaccaactacaacccctccctcaagtcccgcgtcaccatctccgtcgacacctccaagaaccagttctccctcaacctctcctccgtcaccgccgccgacaccgccgtctactactgcgcccgcggcctcatcggctccggctactactacttcgactactgggaccagggcaccctcgtcaccgtctcctcc

SEQ ID NO: 15640 - RNA, 360 nt, synthetic construct
  misc_feature 1..360: note = derived and/or modified sequence opt2 from HuMab-032_HeavyChain_VDJ-Region
  source 1..360: mol_type = other RNA
caggtccagctccagcagtggggcgccggcctcctcaagccctccgagaccctctccctcacctgcgccgtctacggcggctccttctccggctactactggtcctggatccgccagccccccggcaagggcctcgagtggatcggcgagatcaaccactccggcgacaccaactacaacccctccctcacctcccgcgtcaccatctccgtcgacacctccaagaaccagttctccctcaagctctcctccgtcaccgccgccgacaccgccgtctactactgcgcccgcctcttctacggctccggcatctactacttcgactactggggccagggcaccctcgtcaccgtctcctcc

SEQ ID NO: 15641 - RNA, 321 nt, synthetic construct
  misc_feature 1..321: note = derived and/or modified sequence opt2 from HuMab-032_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccaccttccgcctccagtccggcgtcccctcccgcttctccggctccggctccggcaccgacttcaccctcaccatctcctccctccagcccgaggacttcgccacctactactgccagcagtacaactccttcccccccaccttcggccagggcaccaaggtcgagatcaag

SEQ ID NO: 15642 - RNA, 363 nt, synthetic construct
  misc_feature 1..363: note = derived and/or modified sequence opt2 from HuMab-033_HeavyChain_VDJ-Region
  source 1..363: mol_type = other RNA
caggtccagctcgtcgagtccggcggcggcgtcgtccagaccggccgctccctccgcctctcctgcgccgcctccggcttcaccttctcctcccacgccatgcactgggtccgccaggcccccggcaagggcctcgagtgggtcgccgccatctcctacgacggctccaacaagtactacgccgactccgtcaagggccgcttcaccatctcccgcgacaactccaagaacaccctctacctccagatgaactccctccgcgccgaggacaccgccgtctactactgcgcccgcggcgactacatctcctcctccggcgtcttcgactactggggccagggcaccctcgtcaccgtctcctcc

SEQ ID NO: 15643 - RNA, 360 nt, synthetic construct
  misc_feature 1..360: note = derived and/or modified sequence opt2 from HuMab-035_HeavyChain_VDJ-Region
  source 1..360: mol_type = other RNA
caggtccagctccagcagtggggcgccggcctcctcaagccctccgagaccctctccctcacctgcgccatctacggcggctccttctccggctactactggtcctggatccgccagccccccggcaagggcctcgagtggatcggcgagatcaaccactccggcgacaccaactacaacccctccctcacctcccgcgtcaccatctccgtcgacacctccaagaaccagttctccctcaagctctcctccgtcaccgccgccgacaccgccgtctactactgcgcccgcctcttctacggctccggcatctactacttcgactactggggccagggcaccctcgtcaccgtctcctcc

SEQ ID NO: 15644 - RNA, 360 nt, synthetic construct
  misc_feature 1..360: note = derived and/or modified sequence opt2 from HuMab-036_HeavyChain_VDJ-Region
  source 1..360: mol_type = other RNA
caggtccagctccagcagtggggcgccggcctcctcaagccctccgagaccctctccctcacctgcgccgtctacggcggctccttctccgactactactggtcctggatccgccagccccccggcaagggcctcgagtggatcggcgagatcaaccactccggctccaccaactacaacccctccctcaagtcccgcgtcaccatctccgtcgacacctccaagaaccagttctccctcaagctctcctccgtcaccgccgccgacaccgccgtctactactgcgcccgcctctactacggctccggcacctactacttcgactactggggccagggcaccctcgtcaccgtctcctcc

SEQ ID NO: 15645 - RNA, 321 nt, synthetic construct
  misc_feature 1..321: note = derived and/or modified sequence opt2 from HuMab-036_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcacctggtaccagcagaagcccgagaaggcccccaagtccctcatctacgccgcctcccgcctccagtccggcgtcccctcccgcttctccggctccggctccggcaccgacttcaccctcaccatctcctccctccagcccgaggacttcgccacctactactgccagcagtacaactccttcccccccaccttcggccagggcaccaaggtcgagatcaag

SEQ ID NO: 15646 - RNA, 366 nt, synthetic construct
  misc_feature 1..366: note = derived and/or modified sequence opt2 from HuMab-041_HeavyChain_VDJ-Region
  source 1..366: mol_type = other RNA
gaggtccagctcgtccagtccggcgccgaggtcaagaagcccggcgagtccctcaagatctcctgcaagggctccggctactccttcacctcctactggatcggctgggtccgccagatgcccggcaagggcctcgagtggatgggctccatctaccccggcgactcccacacccgctaccgcccctccttccagggccaggtcaccatctccgccgacaagtccatctccaccgcctacctccagtggtcctccctcaaggcctccgacaccgccatgtactactgcgcccgccagaagggcgacttctactacttcttcggcctcgacgtctggggccagggcaccgccatcaccgtctcctcc

SEQ ID NO: 15647 - RNA, 366 nt, synthetic construct
  misc_feature 1..366: note = derived and/or modified sequence opt2 from HuMab-044_HeavyChain_VDJ-Region
  source 1..366: mol_type = other RNA
gaggtccagctcgtccagtccggcgccgaggtcaagaagcccggcgagtccctcaagatctcctgcaagggctccggctaccgcttctcctcctactggatcggctgggtccgccagatgcccggcaagggcctcgagtggatgggctccatcttccccggcgactccgacacccgctactccccctccttccagggccaggtcaccatctccgccgacaagtccatcaccaccgcctacctccagtggtcctccctcaaggcctccgacaccgccatgtactactgcgcccgccaggccggcgactactactactacaacggcatggacgtctggggccagggcaccaccgtcaccgtctcctcc

SEQ ID NO: 15648 - RNA, 357 nt, synthetic construct
  misc_feature 1..357: note = derived and/or modified sequence opt2 from HuMab-049_HeavyChain_VDJ-Region
  source 1..357: mol_type = other RNA
gaggtccagctcctcgagtccggcggcgacctcgtccagcccggcggctccctccgcctctcctgcgccgcctccggcttcaccttctcctcctacgccatgtcctgggtccgccaggcccccggcaagggcctcgagtgggtctccgccatctccggccgcggcggcaccacctactacgccgactccgtcaagggccgcttcaccatctcccgcgacaactccaagtccaccctctgcctccagatgaactccctccgcgccgaggacaccgccgtctactactgcgccaaggcccgcgccaactgggactacttcgactactggggccagggcaccctcgtcaccgtctcctcc

SEQ ID NO: 15649 - RNA, 321 nt, synthetic construct
  misc_feature 1..321: note = derived and/or modified sequence opt2 from HuMab-049_LightChain_VJ-Region
  source 1..321: mol_type = other RNA
gacatccagatgacccagtccccctcctccgtctccgcctccgtcggcgaccgcgtcaccatcacctgccgcgcctcccagggcatctcctcctggctcgcctggtaccagcacaagcccggcaaggcccccaagctcctcatctacgccgcctccatcctccagtccggcgtcccctcccgcttctccggctccggctccggcaccgacttcaccctcaccatctcctccctccgccccgaggacttcgccacctactactgccagcaggccaactccttccccatcaccttcggccagggcacccgcctcgagatcaag

SEQ ID NO: 15650 - RNA, 357 nt, synthetic construct
  misc_feature 1..357: note = derived and/or modified sequence opt2 from HuMab-050_HeavyChain_VDJ-Region
  source 1..357: mol_type = other RNA
gaggtccagctcctcgagtccggcggcggcctcgtccagcccggcggctccctccgcctctcctgcgccgcctccggcttcaccttctcctcctacgccatgaactgggtccgccaggcccccggcaagggcctcgagtgggtctccgccatctccggccgcggcggcaccacctactacgccgactccgtcaagggccgcttcaccatctcccgcgacaactccaagaacaccctctacctccagatgtcctccctccgcgccgaggacaccgccgtctactactgcgccaaggcccgcgccaactgggactacttcgactactggggccagggcaccctcgtcaccgtctcctcc

SEQ ID NO: 15651 - RNA, 321 nt, synthetic construct
  misc_feature 1..321: note = derived and/or modified sequence opt2 from HuMab-050_LightChain_VJ-Region
  source 1..321: mol_type = other RNA
gacatccagatgacccagtccccctcctccgtctccgcctccgtcggcgaccgcgtcaccatcacctgccgcgcctcccagggcatctcctcctggctcgcctggtaccagcacaagcccggcaaggcccccaagctcctcatctacgccgcctccatcctccagtccggcgtcccctcccgcttctccggctccggctccggcaccgacttcaccctcaccatctcctccctccagcccgaggacttcgccacctactactgccagcaggccaactccttccccatcaccttcggccagggcacccgcctcgagatcaag

SEQ ID NO: 15652 - RNA, 360 nt, synthetic construct
  misc_feature 1..360: note = derived and/or modified sequence opt2 from HuMab-054_HeavyChain_VDJ-Region
  source 1..360: mol_type = other RNA
caggtccagctccagcagtggggcgccggcctcctcaagccctccgagaccctctccctcacctgcgccgtctacggcggctccttctccggctactactggtcctggatccgccagccccccggcaagggcctcgagtggatcggcgagatccaccactccggctccaccaactacaacccctccctcaagtcccgcgtcaccatctccgtcgacacctccaagaaccagttctccctcaagctctcctccgtcaccgccgccgacaccgccgtctactactgcgcccgcctctggtacggctccggctcctactacttcgactactggggccagggcaccctcgtcaccgtctcctcc

SEQ ID NO: 15653 - RNA, 321 nt, synthetic construct
  misc_feature 1..321: note = derived and/or modified sequence opt2 from HuMab-054_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactccttcccccccaccttcggcggcggcaccaaggtcgagatcaag

SEQ ID NO: 15654 - RNA, 357 nt, synthetic construct
  misc_feature 1..357: note = derived and/or modified sequence opt2 from HuMab-055_HeavyChain_VDJ-Region
  source 1..357: mol_type = other RNA
gaggtccagctcctcgagtccggcggcggcctcgtccagcccggcggctccctccgcctctcctgcgccgcctccggcttcaccttctcctcctacgccatgaactgggtccgccaggcccccggcaagggcctcgagtgggtctccgccatctccggccgcggcggcaccacctactacgccgactccgtcaagggccgcttcaccatctcccgcgacaactccaagtccaccctctgcctccagatgaactccctccgcgccgaggacaccgccgtctactactgcgccaaggcccgcgccaactgggactacttcgactactggggccagggcaccctcgtcaccgtctcctcc

SEQ ID NO: 15655 - RNA, 366 nt, synthetic construct
  misc_feature 1..366: note = derived and/or modified sequence opt2 from HuMab-059_HeavyChain_VDJ-Region
  source 1..366: mol_type = other RNA
caggtccagctcgtccagtccggcgccgaggtcaagaagcccggcgcctccgtccgcgtcccctgcaaggcctccggctacaccttcacccgctacggcatctcctgggtccgccaggcccccggccagggcctcgagtggatgggctggatctccgcctacaacggcaagacctactacgcccagaagctccagggccgcgtcaccatgaccaccgacacctccacctccaccgcctacatggagctccgctccctccgctccgacgacaccgccgtctactactgcgcccgctcccccctcctctggttcgaggagctctacttcgactactggggccagggcaccctcgtcaccgtctcctcc

SEQ ID NO: 15656 - RNA, 324 nt, synthetic construct
  misc_feature 1..324: note = derived and/or modified sequence opt2 from HuMab-059_LightChain_VJ-Region
  source 1..324: mol_type = other RNA
gagatcgtcctcacccagtcccccggcaccctctccctctcccccggcgagcgcgccaccctctcctgccgcgcctcccagtccgtctcctccacctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggcacctccctcttcaccttcggccccggcaccaaggtcgacatcaag

SEQ ID NO: 15657 - RNA, 366 nt, synthetic construct
  misc_feature 1..366: note = derived and/or modified sequence opt2 from HuMab-060_HeavyChain_VDJ-Region
  source 1..366: mol_type = other RNA
gaggtccagctcgtccagtccggcgccgaggtcaagaagcccggcgagtccctcaagatctcctgcaagggctccggctaccgcttcacctcctactggatcggctgggtccgccagatgcccggcaagggcctcgagtggatgggctccatctaccccggcgactcctacacccgcaactccccctccttccagggccaggtcaccatctccgccgacaagtccatcgccaccgcctacctccagtggaactccctcaaggcctccgacaccgccatgtactactgcgcccgccacgccggcgacttctactacttcgacggcctcgacgtctggggccagggcaccaccgtcaccgtctcctcc

SEQ ID NO: 15658 - RNA, 327 nt, synthetic construct
  misc_feature 1..327: note = derived and/or modified sequence opt2 from HuMab-060_LightChain_VJ-Region
  source 1..327: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccccccatcaccttcggccagggcacccgcctcgagatcaag

SEQ ID NO: 15659 - RNA, 366 nt, synthetic construct
  misc_feature 1..366: note = derived and/or modified sequence opt2 from HuMab-067_HeavyChain_VDJ-Region
  source 1..366: mol_type = other RNA
gaggtccagctcgtccagtccggcgccgaggtcaagaagcccggcgagtccctcaagatctcctgcaagggctccggctactccttcacctcctactggatcggctgggtccgccagatgcccggcaagggcctcgagtggatgggcatcatctaccccggcgactccgacacccgctactccccctccttccagggccaggtcaccatctccgtcgacaagtccatctccaccgcctacctccagtggtcctccctcaaggcctccgacaccgccatgtactactgcgcccgccagaagggcgactactactaccactacggcctcgacgtctggggccagggcaccaccgtcaccgtctcctcc

SEQ ID NO: 15660 - RNA, 366 nt, synthetic construct
  misc_feature 1..366: note = derived and/or modified sequence opt2 from HuMab-072_HeavyChain_VDJ-Region
  source 1..366: mol_type = other RNA
gaggtccagctcgtccagtccggcgccgaggtcaagaagcccggcgagtccctcaagatctcctgcaagggctccggctactccttcacctcctactggatcggctgggtccgccagatgcccggcaagggcctcgagtggatgggcatcatctaccccggcgactccgacacccgctactccccctccttccagggccaggtcaccatctccgccgacaagtccatctccaccgcctacctccagtggtcctccctcaaggcctccgacaccgccatgtactactgcgcccgccagaagggcgactactactacttcaacggcctcgacgtctggggccagggcaccaccgtcaccgtctcctcc

SEQ ID NO: 15661 - RNA, 327 nt, synthetic construct
  misc_feature 1..327: note = derived and/or modified sequence opt2 from HuMab-072_LightChain_VJ-Region
  source 1..327: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccccgcctcaccttcggcggcggcaccaaggtcgagatcaag

SEQ ID NO: 15662 - RNA, 363 nt, synthetic construct
  misc_feature 1..363: note = derived and/or modified sequence opt2 from HuMab-084_HeavyChain_VDJ-Region
  source 1..363: mol_type = other RNA
caggtccagctcgtccagtccggcgccgaggtcaagaagcccggctcctccgtcaaggtctcctgcaaggcctccggcggcaccttccgcacctacgccatcaactgggtccgccaggcccccggccagggcctcgagtggatgggccgcatcaacaccgtcctcggcatcgtcaaccacgcccagaagttccagggccgcgtcaccatcaccgccgacaagtccaccaacaccgcctacatggagctcaactccctccgctccgaggacaccgccgtctactactgcgcccgcgagaagggcgtcgactactactacggcatcgaggtctggggccagggcaccaccgtcaccgtctcctcc

SEQ ID NO: 15663 - RNA, 321 nt, synthetic construct
  misc_feature 1..321: note = derived and/or modified sequence opt2 from HuMab-084_LightChain_VJ-Region
  source 1..321: mol_type = other RNA
gacatccagatgacccagtccccctcctccgtctccgcctccgtcggcgaccgcgtcaccatcacctgccgcgcctcccagggcatctcctcctggctcgcctggtaccagcacaagcccggcaaggcccccaagctcctcatctacgtcgcctccaccctccagtccggcgtcccctcccgcttctccggctccggctccggcaccgacttcaccctcaccatctcctccctccagcccgaggacttcgccacctactactgccagcaggccaactccttccccctcaccttcggcggcggcaccaaggtcgagatcaag

SEQ ID NO: 15664 - RNA, 360 nt, synthetic construct
  misc_feature 1..360: note = derived and/or modified sequence opt2 from HuMab-091_HeavyChain_VDJ-Region
  source 1..360: mol_type = other RNA
caggtccagctccagcagtggggcgccggcctcctcaagccctccgagaccctctccctcacctgcgccgtctccggcggctccttctccggctactactggacctggatccgccagccccccggcaagggcctcgagtggatcggcgagatctaccactccggcgacaccaactacaacccctccctcaagtcccgcgtcaccatctccgtcgacacctccaagaaccagttctccctcaagctctactccgtcaccgccgccgacaccgccgtctactactgcgcccgcctctacttcggctccggcatctactacctcgactactggggccagggcaccctcgtcaccgtctcctcc

SEQ ID NO: 15665 - RNA, 321 nt, synthetic construct
  misc_feature 1..321: note = derived and/or modified sequence opt2 from HuMab-091_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgtctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactccttcccccccaccttcggccagggcaccaaggtcgagatcaag

SEQ ID NO: 15666 - RNA, 366 nt, synthetic construct
  misc_feature 1..366: note = derived and/or modified sequence opt2 from HuMab-093_HeavyChain_VDJ-Region
  source 1..366: mol_type = other RNA
gaggtccagctcgtccagtccggcgccgaggtcaagaagcccggcgagtccctcaagatctcctgcaagggctccggctactccttcacctcctactggatcggctgggtccgccagatgcccggcaagggcctcgagtggatgggccgcatctaccccggcgactccgacacccgctactccccctccttccagggccaggtcaccatctccgccgacaagtccatcaccaccgcctacctccagtggtcctccctccgcgcctccgacaccgccatgtactactgcgcccgccagcgcggcgactactactacttcttcggcctcgacatctggggccagggcaccaccgtcaccgtctccctc

SEQ ID NO: 15667 - RNA, 372 nt, synthetic construct
  misc_feature 1..372: note = derived and/or modified sequence opt2 from HuMab-098_HeavyChain_VDJ-Region
  source 1..372: mol_type = other RNA
gaggtccagctcctcgagtccggcggcggcctcgtccagcccggcggctccctccgcctctcctgcgccgcctccggcttcaccttctccaactacggcatgtcctgggtccgccaggcccccggcaagggcctcgagtgggtctccgccatctccggctccgcctactccacctactacgccgactccgtcaagggccgcttcaccatctcccgcgacaactccaagaacaccctctggctccagatgaactccctccgcgccgaggacaccgccgtctactactgcgccaaggcccactaccacggctccggctcctactacaccctcttcgactactggggccagggcaccctcgtcaccgtctcctcc

SEQ ID NO: 15668 - RNA, 321 nt, synthetic construct
  misc_feature 1..321: note = derived and/or modified sequence opt2 from HuMab-098_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccctacaccttcggccagggcaccaagctcgagatcaag

SEQ ID NO: 15669 - RNA, 372 nt, synthetic construct
  misc_feature 1..372: note = derived and/or modified sequence opt2 from HuMab-100_HeavyChain_VDJ-Region
  source 1..372: mol_type = other RNA
gaggtccagctcctcgagtccggcggcggcctcgtccagcccggcggctccctccgcctctcctgcgccgcctccggcttcaccttcaacaactacggcatgaactgggtccgccaggcccccggcaagggcctcgagtgggtctccgccatctccggcaccggctactccacctactacgccgactccgtcaagggccgcttcaccatctcccgcgacaactccaagaacaccctctacctccagatgaactccctccgcgccgaggacaccgccgtctactactgcgccaaggcccactacttcggctccggctcctactacaccctcttcgactactggggccagggcaccctcgtcaccgtctcctcc

SEQ ID NO: 15670 - RNA, 372 nt, synthetic construct
  misc_feature 1..372: note = derived and/or modified sequence opt2 from HuMab-106_HeavyChain_VDJ-Region
  source 1..372: mol_type = other RNA
gaggtccagctcgtccagtccggcgccgaggtcaagaagcccggcgagtccctcaagatctcctgcaagggctccggctactccttcacccgctactggatcggctgggtccgccagatgcccggcaagggcctcgagtggatgggcatcatctaccccggcgactccgacacccgctactccccctccttccagggccaggtcaccatctccgccgacaagtccatctccaccgcctacctccagtggtcctccctcaaggcctccgacaccgccatgtactactgcgcccgcctcaccggcgaccgcggcttcgactactactccggcatggacgtctggggccagggcaccaccgtcaccgtctcctcc

SEQ ID NO: 15671 - RNA, 321 nt, synthetic construct
  misc_feature 1..321: note = derived and/or modified sequence opt2 from HuMab-106_LightChain_VJ-Region
  source 1..321: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccttcaccttcggccccggcaccaaggtcgacatcaag

SEQ ID NO: 15672 - RNA, 351 nt, synthetic construct
  misc_feature 1..351: note = derived and/or modified sequence opt2 from HuMab_10F8_HeavyChain_V-Region
  source 1..351: mol_type = other RNA
caggtccagctcgtcgagtccggcggcggcgtcgtccagcccggccgctccctccgcctctcctgcaccgcctccggcttcaccttctcccactacggcatgtactgggtccgccaggcccccggcaagggcctcgagtgggtcgccgtcatctggtacgacggctcctacgagtacaacgaggactccgtcaagggccgcttcaccatctcccgcgacaactccaagaacaccctctacctccagatgaactccctccgcgccgaggacaccgccgtctactactgcgcccgcgaccgcgtcggcctcttcgactactggggccagggcaccctcgtcaccgtctcctcc

SEQ ID NO: 15673 - RNA, 408 nt, synthetic construct
  misc_feature 1..408: note = derived and/or modified sequence opt2 from HuMab_10F8_HeavyChain_V-Region_Precursor
  source 1..408: mol_type = other RNA
atggagttcggcctctcctgggtcttcctcgtcgccctcctccgcggcgtccagtgccaggtccagctcgtcgagtccggcggcggcgtcgtccagcccggccgctccctccgcctctcctgcaccgcctccggcttcaccttctcccactacggcatgtactgggtccgccaggcccccggcaagggcctcgagtgggtcgccgtcatctggtacgacggctcctacgagtacaacgccgactccgtcaagggccgcttcaccatctcccgcgacaactccaagaacaccctctacctccagatgaactccctccgcgccgaggacaccgccgtctactactgcgcccgcgaccgcgtcggcctcttcgactactggggccagggcaccctcgtcaccgtctcctcc

SEQ ID NO: 15674 - RNA, 321 nt, synthetic construct
  misc_feature 1..321: note = derived and/or modified sequence opt2 from HuMab_10F8_LightChain_V-Region
  source 1..321: mol_type = other RNA
gagatcgtcctcacccagtcccccggcaccctctccctctcccccggcgagcgcgccaccctctcctgccgcgcctcccagtccatctcctcctcctacctcgcctggtaccagcagaagcccggccaggccccccgcctcctcatctacggcccctcctcccgcgccaccggcatccccgaccgcttctccggctccggctccggcaccgacttcaccctcaccatctcccgcctcgagcccgaggacttcgccgtctactactgccagcagtacgccggctccctcaccttcggccccggcaccaaggtcgacatcaag

SEQ ID NO: 15675 - RNA, 381 nt, synthetic construct
  misc_feature 1..381: note = derived and/or modified sequence opt2 from HuMab_10F8_LightChain_V-Region_Precursor
  source 1..381: mol_type = other RNA
atggagacccccgcccagctcctcttcctcctcctcctctggctccccgacaccaccggcgagatcgtcctcacccagtcccccggcaccctctccctctcccccggcgagcgcgccaccctctcctgccgcgcctcccagtccatctcctcctcctacctcgcctggtaccagcagaagcccggccaggccccccgcctcctcatctacggcccctcctcccgcgccaccggcatccccgaccgcttctccggctccggctccggcaccgacttcaccctcaccatctcccgcctcgagcccgaggacttcgccgtctactactgccagcagtacgccggctccctcaccttcggccccggcaccaaggtcgacatcaag

SEQ ID NO: 15676 - RNA, 357 nt, synthetic construct
  misc_feature 1..357: note = derived and/or modified sequence opt2 from HuMab-111_HeavyChain_VDJ-Region
  source 1..357: mol_type = other RNA
caggtccagctcgtccagtccggcgccgaggtcaagaagcccggctcctccgtcaaggtctcctgcaaggcctccggcggcaccttctcctcctacggcatctcctgggtccgccaggcccccggccccggcctcgagtggatgggccgcatcatccccatcctcggcatcgccaactacgcccagaagttccagggccgcgtcaccatcaccgccgacaagtccaccaacaccgcctacatggagctctcctccctccgctccgaggacaccgccgtctactactgcgcccgcgaccaggagtactcctccaactggtactactggggccagggcaccctcgtcaccgtctcctcc

SEQ ID NO: 15677 - RNA, 321 nt, synthetic construct
  misc_feature 1..321: note = derived and/or modified sequence opt2 from HuMab-111_LightChain_VJ-Region
  source 1..321: mol_type = other RNA
gagatcgtcctcacccagtcccccggcaccctctccctctcccccggcgagcgcgccaccctctcctgccgcgcctcccagtccgtccgctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagctctacggctcctcccccaccttcggccccggcaccaaggtcgacatcaag

SEQ ID NO: 15678 - RNA, 363 nt, synthetic construct
  misc_feature 1..363: note = derived and/or modified sequence opt2 from HuMab-123_HeavyChain_VDJ-Region
  source 1..363: mol_type = other RNA
caggtccagctcgtccagtccggcgccgaggtcaagaagcccggcgcctccgtcaaggtctcctgcaaggccgccggctacaccttcaccaactacggcatctcctgggtccgccaggcccccggccaggccctcgagtggatgggctggatcaccacctactcctccaacaccatctacgcccagaagctccagggccgcgtcaccatgaccaccgacacctccacctccaccgcctacatggagctccgctccctccgctccgacgacaccgccgtctactactgcgcccgcgaccgcgtcgtcgtccgccccgactacttcgactactggggccagggcaccctcgtcaccgtctcctcc

SEQ ID NO: 15679 - RNA, 321 nt, synthetic construct
  misc_feature 1..321: note = derived and/or modified sequence opt2 from HuMab-123_LightChain_VJ-Region
  source 1..321: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacacctccaaccgcgccaccggcatccccgcccgcttctccggctccggctccggcaccgacttcaccctcaccatctcctccctcgagcccgaggacttcgccgtctactactgccagcagcgctcccactggccccgcaccttcggccagggcaccaaggtcgagatcaag

SEQ ID NO: 15680 - RNA, 363 nt, synthetic construct
  misc_feature 1..363: note = derived and/or modified sequence opt2 from HuMab-124_HeavyChain_VDJ-Region
  source 1..363: mol_type = other RNA
caggtccagctcgtccagtccggcgccgaggtcaagaagcccggcgcctccgtcaaggtctcctgcaaggccgccggctacaccttcaccaactacggcatctcctgggtccgccaggcccccggccagggcctcgagtggatgggctggatcatcacctacaacggcaacaccatctacgcccagcgcttccaggaccgcgtcaccatgaccaccgacacctccacctccaccgcctacatggagctccgctccctccgctccgacgacaccgccgtctactactgcgcccgcgaccgcatcatcgtccgccccgactacttcgactactggggccagggcaccctcgtcaccgtctcctcc

SEQ ID NO: 15681 - RNA, 372 nt, synthetic construct
  misc_feature 1..372: note = derived and/or modified sequence opt2 from HuMab-125_HeavyChain_VDJ-Region
  source 1..372: mol_type = other RNA
gaggtccagctcctcgagtccggcggcggcctcgtccagcccggcggctccctccgcctctcctgcgccgcctccggcttcaccttcaccgactacgccatgaactgggtccgccaggcccccggcaagggcctcgagtgggtctccaccatctccggctccggctacgccacctactacgccgactccgtcaagggccgcttcaccatctcccgcgacaactccaagaccaccctctacctccagatgaactccctccgcgccgaggacaccgccgtctactactgcgccaagggccacaccctcggctccggctcctactacaccctcttcgactactggggccagggcaccctcgtcaccgtctcctcc

SEQ ID NO: 15682 - RNA, 321 nt, synthetic construct
  misc_feature 1..321: note = derived and/or modified sequence opt2 from HuMab-125_LightChain_VJ-Region
  source 1..321: mol_type = other RNA
gacatccagatgacccagtccccctcctccctctccgcctccgtcggcgaccgcgtcaccatcacctgccgcgcctcccagggcatcaactcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccctacaccttcggccagggcaccaagctcgagatcaag

SEQ ID NO: 15683 - RNA, 369 nt, synthetic construct
  misc_feature 1..369: note = derived and/or modified sequence opt2 from HuMab-127_HeavyChain_VDJ-Region
  source 1..369: mol_type = other RNA
gaggtccagctcgtccagtccggcgccgaggtcaagaagcccggcgagtccctcaccatctcctgcaagggctccggctactccttctccatctactggatcggctgggtccgccagatgcccggcaagggcctcgagtggatgggcatcatcttccccggcgactccgacatccgctactccccctccttccagggccaggtcaccatctccgccgacaagtccatctccaccgcctacctccagtggtcctccctcaaggcctccgacaccgccatgtactactgcgcccgccagcccggcgactggtccccccgccactggtacttcgacctctggggccgcggcaccctcgtcaccgtctcctcc

SEQ ID NO: 15684 - RNA, 321 nt, synthetic construct
  misc_feature 1..321: note = derived and/or modified sequence opt2 from HuMab-127_LightChain_VJ-Region
  source 1..321: mol_type = other RNA
gtcatctggatgacccagtccccctccctcctctccgcctccaccggcgaccgcgtcaccatctcctgccgcatgtcccagggcatctcctcctacctcgcctggtaccagcagaagcccggcaaggcccccgagctcctcatctacgccgcctccaccctccagtccggcgtcccctcccgcttctccggctccggctccggcaccgacttcaccctcaccatctcctacctccagtccgaggacttcgccacctactactgccagcagtactactccttccccctcaccttcggcggcggcaccaaggtcgagatcaag

SEQ ID NO: 15685 - RNA, 357 nt, synthetic construct
  misc_feature 1..357: note = derived and/or modified sequence opt2 from HuMab-129_HeavyChain_VDJ-Region
  source 1..357: mol_type = other RNA
caggtccagctcgtcgagtccggcggcggcgtcgtccagcccggccgctccctccgcctctcctgcgccgcctccggcttcaccttctccaccttcgccatccactgggtccgccaggcccccggcaagggcctcgagtgggtcgccgtcatctcctacgacggcggccacaagttctacgccgactccgtcaagggccgcttcaccatctcccgcgacaactccaagaacaccctctacctccagatgaactccctccgcgccgaggacaccgccatgtactactgcgcccgcggcctcggcgtctggggcgccttcgactactggggccagggcaccctcgtcaccgtctcctcc

SEQ ID NO: 15686 - RNA, 318 nt, synthetic construct
  misc_feature 1..318: note = derived and/or modified sequence opt2 from HuMab-129_LightChain_VJ-Region
  source 1..318: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggtggaccttcggccagggcaccaaggtcgagatcaag

SEQ ID NO: 15687 - RNA, 375 nt, synthetic construct
  misc_feature 1..375: note = derived and/or modified sequence opt2 from HuMab-132_HeavyChain_VDJ-Region
  source 1..375: mol_type = other RNA
caggtccagctcgtccagtccggcgccgaggtcaagaagcccggcgcctccgtcaaggtctcctgcaaggcctccggctacaccttcacctcctacggcatctcctgggtccgccaggcccccggccagggcctcgagtggatgggctggatctccgcctacaacggcaactccaactacgtccagaagttccagggccgcgtcaccatgaccaccgacaccaccacctccaccgcctacatggagctccgctccctcacctccgacgacaccgccgtctactactgcgcccgcgagtactcctacgactccggcacctacttctactacggcatggacgtctggggccagggcaccaccgtcaccgtctcctcc

SEQ ID NO: 15688 - RNA, 324 nt, synthetic construct
  misc_feature 1..324: note = derived and/or modified sequence opt2 from HuMab-132_LightChain_VJ-Region
  source 1..324: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccatgtacaccttcggccagggcaccaagctcgagatcaag

SEQ ID NO: 15689 - RNA, 360 nt, synthetic construct
  misc_feature 1..360: note = derived and/or modified sequence opt2 from HuMab-143_HeavyChain_VDJ-Region
  source 1..360: mol_type = other RNA
caggtccagctccagcagtggggcgccggcctcctcaagccctccgagaccctctccctcacctgcgccgtctacggcggctccttctccggctactactggaactggatccgccagccccccggcaagggcctcgagtggatcggcgagatccaccactccggctccgccaactacaacccctccctcatgtcccgcgtcaccatctccgtcgacacctccaagaaccagttctccctccagctctcctccgtcaccgccgccgacaccgccgtctactactgcgcccgcggctactacggctccggctactactacttcgactactggggccagggcaccctcgtcaccgtctcctcc

SEQ ID NO: 15690 - RNA, 321 nt, synthetic construct
  misc_feature 1..321: note = derived and/or modified sequence opt2 from HuMab-143_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcccgcctccagtccggcgtcccctcccgcttctccggctccggctccggcaccgacttcaccctcaccatctcctccctccagcccgaggacttcgccacctactactgccagcagtacaactcctaccccatcaccttcggccagggcacccgcctcgagatcaag

SEQ ID NO: 15691 - RNA, 366 nt, synthetic construct
  misc_feature 1..366: note = derived and/or modified sequence opt2 from HuMab-150_HeavyChain_VDJ-Region
  source 1..366: mol_type = other RNA
gaggtccagctcgtccagtccggcgccgaggtcaagaagcccggcgagtccctcaagatctcctgcaagggctccggctactccttcacctcctactggatcggctgggtccgccagatgcccggcaagggcctcgagtggatgggctccatctaccccggcgactcccacacccgctaccgcccctccttccagggccaggtcaccatctccgccgacaagtccatctccaccgcctacctccagtggtcctccctcaaggcctccgacaccgccatgtactactgcgcccgccaggccggcgactactactactacaacggcatggacgtctggggccagggcaccaccgtcaccgtctcctcc

SEQ ID NO: 15692 - RNA, 321 nt, synthetic construct
  misc_feature 1..321: note = derived and/or modified sequence opt2 from HuMab-150_LightChain_VJ-Region
  source 1..321: mol_type = other RNA
gagatcgtcctcacccagtcccccggcaccctctccctctcccccggcgagcgcgccaccctctcctgccgcgcctcccagtccgtctcctcctcctacctcacctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccctcaccttcggcggcggcaccaaggtcgagatcaag

SEQ ID NO: 15693 - RNA, 363 nt, synthetic construct
  misc_feature 1..363: note = derived and/or modified sequence opt2 from HuMab-152_HeavyChain_VDJ-Region
  source 1..363: mol_type = other RNA
caggtccaggtcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctcctacaagtactacgccgactccgtcaagggccgcttcaccatctcccgcgacaactccaagaacaccctctacctccagatgaactccctccgcgccgaggacaccgccgtctactactgcgcccgcggctccatcaccggctccaccggcgtcttcgactactggggccagggcaccctcgtcaccgtctcctcc

SEQ ID NO: 15694 - RNA, 321 nt, synthetic construct
  misc_feature 1..321: note = derived and/or modified sequence opt2 from HuMab-152_LightChain_VJ-Region
  source 1..321: mol_type = other RNA
gacatccagatgacccagtccccctcctccctctccgcctccgtcggcgaccgcgtcaccatcacctgccgcgcctcccagggcatcaactcctggctcgcctggtaccagcagaagcccgagaaggcccccaagtccctcatctacgacgcctcctccctccagtccggcgtcccctcccgcttctccggctccggctccggcaccgacttcaccctcaccatctcctccctccagcccgagaacttcgccacctactactgccagcagtacaactcctaccccatcaccttcggccagggcacccgcctcgagatcaag

SEQ ID NO: 15695 - RNA, 363 nt, synthetic construct
  misc_feature 1..363: note = derived and/or modified sequence opt2 from HuMab-153_HeavyChain_VDJ-Region
  source 1..363: mol_type = other RNA
caggtccagctcgtcgagtccggcggcggcgtcgtccagcccggccgctccctccgcctctcctgcgccgcctccggcttcaccttctccgactacgtcatccactgggtccgccaggcccccggcaagggcctcgagtgggtcaccgtcatctcctacgacggctccaacaagtactacgccgactccgtcaagggccgcttcaccatctcccgcgacaactccaagaacaccctctacctccagatgaactccctctccgccgaggacaccgccatgtactactgcgcccgcggcggcatcaccggcaccaccggcgtcttcgactactggggccagggcaccctcgtcaccgtctcctcc

SEQ ID NO: 15696 - RNA, 321 nt, synthetic construct
  misc_feature 1..321: note = derived and/or modified sequence opt2 from HuMab-153_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgacgcctcctccctccagtccggcgtcccctcccgcttctccggctccggctacggcaccgacttctccctcaccatctcctccctccagcccgaggacttcgccatctactactgccagcagtacaagtcctaccccatcaccttcggccagggcacccgcctcgagatcaag

SEQ ID NO: 15697 - RNA, 378 nt, synthetic construct
  misc_feature 1..378: note = derived and/or modified sequence opt2 from HuMab-159_HeavyChain_VDJ-Region
  source 1..378: mol_type = other RNA
gaggtccagctcgtccagtccggcgccgaggtcaagaagcccggcgagtccctcaagatctcctgcaagggctccggctacaacttcacctcctactggatcggctgggtccgccagatgcccggcaagggcctcgagtggatgggcatcatctaccccggcgactccgacacccgctactccccctccttccagggccaggtcaccatctccgccgacaagtccatctccaccgcctacctccagtggtcctccctcaaggcctccgacaccgccatgtactactgcgcccgctggggcacctactacgacatcctcaccggctacttcaactggttcgacccctggggccagggcaccctcgtcaccgtctcctcc

SEQ ID NO: 15698 - RNA, 321 nt, synthetic construct
  misc_feature 1..321: note = derived and/or modified sequence opt2 from HuMab-159_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtactacatctacccctggaccttcggccagggcaccaaggtcgagatcaag

SEQ ID NO: 15699 - RNA, 363 nt, synthetic construct
  misc_feature 1..363: note = derived and/or modified sequence opt2 from HuMab-160_HeavyChain_VDJ-Region
  source 1..363: mol_type = other RNA
caggtccagctcgtcgagtccggcggcggcgtcgtccagcccggccgctccctccgcctctcctgcgccgcctccggcttcaccttctcctcccacgccatgcactgggtccgccaggcccccggcaagggcctcgagtgggtcgccgccatctcctacgacggctccaacaagtactacgccgactccgtcaagggccgcttcaccatctcccgcgacaactccaagaacaccatgtacctccagatgaactccctccgcgccgaggacaccgccatgtgctactgcgcccgcggctccatcaccggctccaccggcgtcttcgactactggggccagggcaccctcgtcaccgtctcctcc

SEQ ID NO: 15700 - RNA, 321 nt, synthetic construct
  misc_feature 1..321: note = derived and/or modified sequence opt2 from HuMab-160_LightChain_VJ-Region
  source 1..321: mol_type = other RNA
gacatccagatgacccagtccccctcctccctctccgcctccgtcggcgaccgcgtcaccatcacctgccgcgcctcccaggacatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctaccccatcaccttcggccagggcacccgcctcgagatcaag

SEQ ID NO: 15701 - RNA, 372 nt, synthetic construct
  misc_feature 1..372: note = derived and/or modified sequence opt2 from HuMab-162_HeavyChain_VDJ-Region
  source 1..372: mol_type = other RNA
gaggtccagctctgggagtccggcggcggctccgtccagcccggcggctccctccgcctctcctgcgccgcctccggcttcaccttctcctcctacggcatgtcctgggtccgccaggcccccggcaagggcctcgagtgggtctccggcatctccggctccggctactccacctactacgccgactccgtcaagggccgcttcaccatctcccgcgacaactccaagaacaccctctacctccagatgaactccctccgcgccgaggacaccgccgtctactactgcgccaagggctactaccacggctccggctcctactacacctccttcgactactggggccagggcaccctcgtcaccgtctcctcc

SEQ ID NO: 15702 - RNA, 321 nt, synthetic construct
  misc_feature 1..321: note = derived and/or modified sequence opt2 from HuMab-162_LightChain_VJ-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctaccccctcaccttcggcggcggcaccaaggtcgagatcaag

SEQ ID NO: 15703 - RNA, 366 nt, synthetic construct
  misc_feature 1..366: note = derived and/or modified sequence opt2 from HuMab-163_HeavyChain_VDJ-Region
  source 1..366: mol_type = other RNA
gaggtccagctcgtccagtccggcgccgaggtcaagaagcccggcgagtccctcaagatctcctgccagggctccggctaccgcttcatctcctactggatcggctgggtccgccagatgcccggcaagggcctcgagtggatgggccgcatctaccccggcgactccgacacccgctactccccctccttccagggccaggtcaccatctccgtcgacaagtccatctccaccgcctacctccagtggtcctccctcaaggcctccgacaccgccatgtactactgcgcccgccagcgcggcgactactactacttcaacggcctcgacgtctggggccagggcaccaccgtcaccgtctcctcc

SEQ ID NO: 15704 - RNA, 321 nt, synthetic construct
  misc_feature 1..321: note = derived and/or modified sequence opt2 from HuMab-163_LightChain_VJ-Region
  source 1..321: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccctcaccttcggcggcggcaccaaggtcgagatcaag

SEQ ID NO: 15705 - RNA, 363 nt, synthetic construct
  misc_feature 1..363: note = derived and/or modified sequence opt2 from HuMab-166_HeavyChain_VDJ-Region
  source 1..363: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacgagtactacgccgactccgtcaagggccgcttcaccatctcccgcgacaactccaagaacaccctctacctccagatgaactccctccgcgccgaggacaccgccgtctactactgcgcccgcggctccatcatcggctccaccggcgtcttcgactactggggccagggcaccctcgtcaccgtctcctcc

SEQ ID NO: 15706 - RNA, 321 nt, synthetic construct
  misc_feature 1..321: note = derived and/or modified sequence opt2 from HuMab-166_LightChain_VJ-Region
  source 1..321: mol_type = other RNA
gacatccagatgacccagtccccctcctccctctccgcctccgtcggcgaccgcgtcaccatcacctgccgcgcctcccagggcatctccaactggctcgcctggtaccagcagaagcccgagaaggcccccaagtccctcatctacgacgcctcctccctccagtccggcgtcccctcccgcttctccggctccggctccggcaccgacttcaccctcaccatctcctccctccagcccgaggacttcgccacctactactgccagcagtacaactcctaccccatcaccttcggccagggcacccgcctcgagatcaag

SEQ ID NO: 15707 - RNA, 363 nt, synthetic construct
  misc_feature 1..363: note = derived and/or modified sequence opt2 from HuMab-167_HeavyChain_VDJ-Region
  source 1..363: mol_type = other RNA
caggtccagctcgtcgagtccggcggcggcgtcgtccagcccggccgctccctccgcctctcctgcgccgcctccggcttcaccttctcctcctacgccatccactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgcccgcggctccatcaccggctccaccggcgtcttcgactactggggccagggcaccctcgtcaccgtctcctcc

SEQ ID NO: 15708 - RNA, 363 nt, synthetic construct
  misc_feature 1..363: note = derived and/or modified sequence opt2 from HuMab-169_HeavyChain_VDJ-Region
  source 1..363: mol_type = other RNA
caggtccagctcgtccagtccggcgccgaggtcaagaagcccggcgcctccgtcaaggtctcctgcaaggcctccggctacaccttcaccaactacggcatctcctgggtccgccaggcccccggccagggcctcgagtggatgggctggctctccgcctactccggcaacaccatctacgcccagaagctccagggccgcgtcaccatgaccaccgacacctccaccaccaccgcctacatggagctccgctccctccgctccgacgacaccgccgtctactactgcgcccgcgaccgcatcgtcgtccgccccgactacttcgactactggggccagggcaccctcgtcaccgtctcctcc

SEQ ID NO: 15709 - RNA, 321 nt, synthetic construct
  misc_feature 1..321: note = derived and/or modified sequence opt2 from HuMab-169_LightChain_VJ-Region
  source 1..321: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccgcaccttcggccagggcaccaaggtcgagatcaag

SEQ ID NO: 15710 - RNA, 366 nt, synthetic construct
  misc_feature 1..366: note = derived and/or modified sequence opt2 from HuMab-7D8_HeavyChain_VH-Region
  source 1..366: mol_type = other RNA
gaggtccagctcgtcgagtccggcggcggcctcgtccagcccgaccgctccctccgcctctcctgcgccgcctccggcttcaccttccacgactacgccatgcactgggtccgccaggcccccggcaagggcctcgagtgggtctccaccatctcctggaactccggcaccatcggctacgccgactccgtcaagggccgcttcaccatctcccgcgacaacgccaagaactccctctacctccagatgaactccctccgcgccgaggacaccgccctctactactgcgccaaggacatccagtacggcaactactactacggcatggacgtctggggccagggcaccaccgtcaccgtctcctcc

SEQ ID NO: 15711 - RNA, 366 nt, synthetic construct; identical to SEQ ID NO: 15710
  misc_feature 1..366: note = derived and/or modified sequence opt2 from HuMab-7D8_HeavyChain_V-Region
  source 1..366: mol_type = other RNA

SEQ ID NO: 15712 - RNA, 321 nt, synthetic construct
  misc_feature 1..321: note = derived and/or modified sequence opt2 from HuMab-7D8_LightChain_VL-Region
  source 1..321: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccatcaccttcggccagggcacccgcctcgagatcaag

SEQ ID NO: 15713 - RNA, 321 nt, synthetic construct; identical to SEQ ID NO: 15712
  misc_feature 1..321: note = derived and/or modified sequence opt2 from HuMab-7D8_LightChain_V-Region
  source 1..321: mol_type = other RNA

SEQ ID NO: 15714 - RNA, 324 nt, synthetic construct
  misc_feature 1..324: note = derived and/or modified sequence opt2 from huMAb-anti-MSP10.1_LightChain_VJ-Region
  source 1..324: mol_type = other RNA
gagatcgtcctcacccagtcccccgacatcctctccctctcccccggcgagcgcgccaccctctcctgccgcgcctcccaggccctcaccgccaagtacctcgcctggtaccagcagaagcccggccaggtcccccgcctcctcatctacggctcctccacccgcgccaccggcatccccgaccgcttccgcggctccggctccggcaccgacttcaccctcaccatctcccgcctcgagcccgccgactccgccgtctactactgccagcagtacgaggactccccctggaccttcggccagggcaccaagctcgagatcaag

SEQ ID NO: 15715 - RNA, 324 nt, synthetic construct
  misc_feature 1..324: note = derived and/or modified sequence opt2 from huMAb-anti-MSP10.2_LightChain_VJ-Region
  source 1..324: mol_type = other RNA
gagatcgtcctcacccagtcccccgacaccctctccctctcccccggcgagaccgccaccctctcctgccgcgcctcccagaccgtccgccgcaactccctcgcctggtaccagcagaagcccggccaggccccccgcctcctcatctacggcgcctccgaccgcgccaccggcatccccgaccgcttctccggctccggcttcggcaccgacttcaccctcaccgtctccggcctcgagcccgaggacttcgccgtctactactgccagcagtacggcacctccccccgcaccttcggccagggcaccaagctcgagatcaag

SEQ ID NO: 15716 - RNA, 324 nt, synthetic construct
  misc_feature 1..324: note = derived and/or modified sequence opt2 from HUMAB-Clone_18_VJ-Region
  source 1..324: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaagcgcgccaccggcatccccgcccgcttctccggctccggctccggcaccgacttcaccctcaccatctcctccctcgagcccgaggacttcgccgtctactactgccagcagcgctccaagtggcccccctggaccttcggccagggcaccaaggtcgagtccaag

SEQ ID NO: 15717 - RNA, 324 nt, synthetic construct
  misc_feature 1..324: note = derived and/or modified sequence opt2 from HUMAB-Clone_22_VJ-Region
  source 1..324: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaagtggcccccctggaccttcggccagggcaccaaggtcgagatcaag

SEQ ID NO: 15718 - RNA, 432 nt, synthetic construct
  misc_feature 1..432: note = derived and/or modified sequence opt2 from HuMab-L612_Chain_VDJ-Region_Precursor
  source 1..432: mol_type = other RNA
atggagttcggcctcacctggctcttcctcgtcgccaacctcaagggcgtccagtgcgaggtccagctcctcgactccggcggcggcctcgtccagcccggcggctgcctccgcctctcctgcgccgcctccggcttcaccttctcctcctgcgccatgtcctgggtccgccaggcccccggcaagggcctcgagtgggtctccgccatctccggctccggcggctccacctactacgccgactccgtcaagggccgcttcaccatctcccgcgacaagtccaagaacaccctctacctccagatgaactccctccgcgccgaggacaccgccgtctactactgcgccaagggcggcaacgacatcctcaccggctactacgcctggggccagggcaccctcgtcaccgtctcctccggctccgcctccgcc

SEQ ID NO: 15719 - RNA, 321 nt, synthetic construct
  misc_feature 1..321: note = derived and/or modified sequence opt2 from HuMab_LC5002-002_LightChain_V-Region
  source 1..321: mol_type = other RNA
gacatccagatgacccagtccccctcctccctctccgcctccgtcggcgaccgcgtcaccatcacctgccgcgcctcccagggcatctcccgctgggtcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccctggaccttcggccagggcaccaaggtcgagatcaag

SEQ ID NO: 15720 - RNA, 357 nt, synthetic construct
  misc_feature 1..357: note = derived and/or modified sequence opt2 from HuMab_LC5002-002_gamma1-Chain_V-Region
  source 1..357: mol_type = other RNA
gaggtccagctcctcgagtccggcggcggcctcgtccagcccggcggctccctccgcctctcctgcgccgcctccggcttcaccttcaacatctacgccatgaactgggtccgccaggcccccggcaagggcctcgagtgggtctccgtcatctccggccgcggcatcaccacctactacgccgactccgtcaagggccgcttcaccatctcccgcgacaactccaagaacaccctctacctccagatgaactccctccgcgccgacgacaccgccgtctactactgcgccaagggctcctcctcctggaccgacttcgactactggggccagggcaccctcgtcaccgtctcctcc

SEQ ID NO: 15721 - RNA, 321 nt, synthetic construct
  misc_feature 1..321: note = derived and/or modified sequence opt2 from HuMab_LC5002-003_LightChain_V-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccctggaccttcggccagggcaccaaggtcgagatcaag

SEQ ID NO: 15722 - RNA, 357 nt, synthetic construct
  misc_feature 1..357: note = derived and/or modified sequence opt2 from HuMab_LC5002-003_gamma1-Chain_V-Region
  source 1..357: mol_type = other RNA
gaggtccagctcctcgagtccggcggcgacctcatccagcccggcggctccctccgcctctcctgcgccgcctccggcttcaccttcaacatctacgccatgaactgggtccgccaggcccccggcaagggcctcgagtgggtctccgtcatctccggccgcggcatcaccacctactacgccgactccgtcaagggccgcttcaccatctcccgcgacaactccaagaacaccctctacctccagatggactccctccgcgccgaggacaccgccgtctactactgcgccaagggctcctcctactggaccgacttcgactactggggccagggcaccctcgtcaccgtctcctcc

SEQ ID NO: 15723 - RNA, 321 nt, synthetic construct
  misc_feature 1..321: note = derived and/or modified sequence opt2 from HuMab_LC5002-005_LightChain_V-Region
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcccacccccccaccttcggccagggcaccaagctcgagatcaag

SEQ ID NO: 15724 - RNA, 354 nt, synthetic construct
  misc_feature 1..354: note = derived and/or modified sequence opt2 from HuMab_LC5002-005_gamma1-Chain_V-Region
  source 1..354: mol_type = other RNA
gaggtccaggtcctcgactccggcggcggcctcgtccagcccggcggctccctccgcctctcctgcaccgcctccggcttcaccttccgcctctacaccatgtcctgggtccgccagacccccggccgcggcctcgagtgggtctccggcatctccggctccggcctctccacctacttcgccgactccgtcaagggccgcttcaccatctcccgcgacaactccaagaacaccgtctacctccagatgaactccctccgcgccgaggacaccgccgtctactactgcgccaaggagggcgactggatctacttcgactcctggggccagggcaccctcgtcatcgtctcctcc

SEQ ID NO: 15725 - RNA, 321 nt, synthetic construct
  misc_feature 1..321: note = derived and/or modified sequence opt2 from HuMab_LC5002-007_LightChain_V-Region
  source 1..321: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccatcggcatccccgaccgcttctccggctccggctccggcaccgacttcaccctcaccatctcccgcctcgagcccgaggacttcgccgtctactactgccagcactacggctcctccctcaccttcggcggcggcaccaaggtcgagatcaag

SEQ ID NO: 15726 - RNA, 369 nt, synthetic construct
  misc_feature 1..369: note = derived and/or modified sequence opt2 from HuMab_LC5002-007__gamma1-Chain_V-Region
  source 1..369: mol_type = other RNA
caggtccagctcgtccagtccggcgccgaggtcaagaagcccggctcctccgtcaaggtctcctgcaaggtctccggcggcaccttctcctcctacgccttctcctgggtccgccaggcccccggccagggcctcgagtggatgggccgcatcatccccatcctcggccgcaccaactacgcccagaagttccagggccgcgtcaccatcaccgccgacaagtccacctccaccgcctacatggaggtctcctccctccgctccgaggacaccgccgtctactactgcgcccgcgagggcgagaccctcgactacttctactacggcatggacgtctggggccagggcaccaccgtcaccgtctcctcc

SEQ ID NO: 15727 - RNA, 357 nt, synthetic construct
  misc_feature 1..357: note = derived and/or modified sequence opt2 from HuMab_LC5002-018_gamma1-Chain_V-Region
  source 1..357: mol_type = other RNA
gaggtccagctcctcgagtccggcggcggcctcgtccagcccggcggctccctccgcctctcctgcgccgcctccggcttcaccttcaacatctacgccatgaactgggtccgccaggcccccggcaagggcctcgagtgggtctccgtcatctccggctccggcgtcaccacctactacgccgactccgtcaagggccgcttcaccatctcccgcgacaactccaagaacaccctctacctccagatgaactccctccgcgccgaggacaccgccgtctactactgcgccaagggctcctcctggtacgtcgacttcgactactggggccagggcaccctcgtcaccgtctcctcc

SEQ ID NO: 15728 - RNA, 1347 nt, synthetic construct
  misc_feature 1..1347: note = derived and/or modified sequence opt2 from Ibalizumab_HeavyChain1
  source 1..1347: mol_type = other RNA
caggtccagctccagcagtccggccccgaggtcgtcaagcccggcgcctccgtcaagatgtcctgcaaggcctccggctacaccttcacctcctacgtcatccactgggtccgccagaagcccggccagggcctcgactggatcggctacatcaacccctacaacgacggcaccgactacgacgagaagttcaagggcaaggccaccctcacctccgacacctccacctccaccgcctacatggagctctcctccctccgctccgaggacaccgccgtctactactgcgcccgcgagaaggacaactacgccaccggcgcctggttcgcctactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15729 - RNA, 657 nt, synthetic construct
  misc_feature 1..657: note = derived and/or modified sequence opt2 from Ibalizumab_LightChain1
  source 1..657: mol_type = other RNA
gacatcgtcatgacccagtcccccgactccctcgccgtctccctcggcgagcgcgtcaccatgaactgcaagtcctcccagtccctcctctactccaccaaccagaagaactacctcgcctggtaccagcagaagcccggccagtcccccaagctcctcatctactgggcctccacccgcgagtccggcgtccccgaccgcttctccggctccggctccggcaccgacttcaccctcaccatctcctccgtccaggccgaggacgtcgccgtctactactgccagcagtactactcctaccgcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15730 - RNA, 1329 nt, synthetic construct
  misc_feature 1..1329: note = derived and/or modified sequence opt2 from Ibritumomab_tiuxetan_HeavyChain
  source 1..1329: mol_type = other RNA
caggcctacctccagcagtccggcgccgagctcgtccgccccggcgcctccgtcaagatgtcctgcaaggcctccggctacaccttcacctcctacaacatgcactgggtcaagcagaccccccgccagggcctcgagtggatcggcgccatctaccccggcaacggcgacacctcctacaaccagaagttcaagggcaaggccaccctcaccgtcgacaagtcctcctccaccgcctacatgcagctctcctccctcacctccgaggactccgccgtctacttctgcgcccgcgtcgtctactactccaactcctactggtacttcgacgtctggggcaccggcaccaccgtcaccgtctccgccccctccgtctaccccctcgcccccgtctgcggcgacaccaccggctcctccgtcaccctcggctgcctcgtcaagggctacttccccgagcccgtcaccctcacctggaactccggctccctctcctccggcgtccacaccttccccgccgtcctccagtccgacctctacaccctctcctcctccgtcaccgtcacctcctccacctggccctcccagtccatcacctgcaacgtcgcccaccccgcctcctccaccaaggtcgacaagaagatcgagccccgcggccccaccatcaagccctgccccccctgcaagtgccccgcccccaacctcctcggcggcccctccgtcttcatcttcccccccaagatcaaggacgtcctcatgatctccctctcccccatcgtcacctgcgtcgtcgtcgacgtctccgaggacgaccccgacgtccagatctcctggttcgtcaacaacgtcgaggtccacaccgcccagacccagacccaccgcgaggactacaactccaccctccgcgtcgtctccgccctccccatccagcaccaggactggatgtccggcaaggagttcaagtgcaaggtcaacaacaaggacctccccgcccccatcgagcgcaccatctccaagcccaagggctccgtccgcgccccccaggtctacgtcctccccccccccgaggaggagatgaccaagaagcaggtcaccctcacctgcatggtcaccgacttcatgcccgaggacatctacgtcgagtggaccaacaacggcaagaccgagctcaactacaagaacaccgagcccgtcctcgactccgacggctcctacttcatgtactccaagctccgcgtcgagaagaagaactgggtcgagcgcaactcctactcctgctccgtcgtccacgagggcctccacaaccaccacaccaccaagtccttctcccgc

SEQ ID NO: 15731 - RNA, 627 nt, synthetic construct
  misc_feature 1..627: note = derived and/or modified sequence opt2 from Ibritumomab_tiuxetan_LightChain
  source 1..627: mol_type = other RNA
cagatcgtcctctcccagtcccccgccatcctctccgcctcccccggcgagaaggtcaccatgacctgccgcgcctcctcctccgtctcctacatgcactggtaccagcagaagcccggctcctcccccaagccctggatctacgccccctccaacctcgcctccggcgtccccgcccgcttctccggctccggctccggcacctcctactccctcaccatctcccgcgtcgaggccgaggacgccgccacctactactgccagcagtggtccttcaacccccccaccttcggcgccggcaccaagctcgagctcaagcgcgccgacgccgcccccaccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaac

SEQ ID NO: 15732 - RNA, 1368 nt, synthetic construct
  misc_feature 1..1368: note = derived and/or modified sequence opt2 from Icrucumab_HeavyChain1
  source 1..1368: mol_type = other RNA
caggcccaggtcgtcgagtccggcggcggcgtcgtccagtccggccgctccctccgcctctcctgcgccgcctccggcttcgccttctcctcctacggcatgcactgggtccgccaggcccccggcaagggcctcgagtgggtcgccgtcatctggtacgacggctccaacaagtactacgccgactccgtccgcggccgcttcaccatctcccgcgacaactccgagaacaccctctacctccagatgaactccctccgcgccgaggacaccgccgtctactactgcgcccgcgaccactacggctccggcgtccaccactacttctactacggcctcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15733 - RNA, 645 nt, synthetic construct
  misc_feature 1..645: note = derived and/or modified sequence opt2 from Icrucumab_LightChain1
  source 1..645: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctcccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15734 - RNA, 675 nt, synthetic construct
  misc_feature 1..675: note = derived and/or modified sequence opt2 from Idarucizumab_HeavyChain1
  source 1..675: mol_type = other RNA
caggtccagctccaggagtccggccccggcctcgtcaagccctccgagaccctctccctcacctgcaccgtctccggcttctccctcacctcctacatcgtcgactggatccgccagccccccggcaagggcctcgagtggatcggcgtcatctgggccggcggctccaccggctacaactccgccctccgctcccgcgtctccatcaccaaggacacctccaagaaccagttctccctcaagctctcctccgtcaccgccgccgacaccgccgtctactactgcgcctccgccgcctactactcctactacaactacgacggcttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 15735 - RNA, 657 nt, synthetic construct
  misc_feature 1..657: note = derived and/or modified sequence opt2 from Idarucizumab_LightChain1
  source 1..657: mol_type = other RNA
gacgtcgtcatgacccagtcccccctctccctccccgtcaccctcggccagcccgcctccatctcctgcaagtcctcccagtccctcctctacaccgacggcaagacctacctctactggttcctccagcgccccggccagtccccccgccgcctcatctacctcgtctccaagctcgactccggcgtccccgaccgcttctccggctccggctccggcaccgacttcaccctcaagatctcccgcgtcgaggccgaggacgtcggcgtctactactgcctccagtccacccacttcccccacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15736 - RNA, 1332 nt, synthetic construct
  misc_feature 1..1332: note = derived and/or modified sequence opt2 from Igatuzuab_HeavyChain1
  source 1..1332: mol_type = other RNA
caggtccagctcgtccagtccggcgccgaggtcaagaagcccggctcctccgtcaaggtctcctgcaaggcctccggcttcaccttcaccgactacaagatccactgggtccgccaggcccccggccagggcctcgagtggggctacttcaaccccaactccggctactccacctacgcccagaagttccagggccgcgtcaccatcaccgccgacaagtccacctccaccgcctacgagctctcctccctccgctccgaggacaccgccgtctactactgcgcccgcctctcccccggcggctactacgtcgacgcctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 15737 - RNA, 636 nt, synthetic construct
  misc_feature 1..636: note = derived and/or modified sequence opt2 from Igatuzuab_LightChain1
  source 1..636: mol_type = other RNA
gacatccagacccagtccccctcctccctctccgcctccgtcggcgaccgcgtcaccatcacctgccgcgcctcccagggcatcaacaactacctcaactggtaccagcagaagcccggcaaggcccccaagcgcctcatctacaacaccaacaacctccagaccggcgtcccctcccgcttctccggctccggctccggcaccgagttcaccctcaccatctcctccctccagcccgaggacttcgccacctactactgcctccagcacaactccttccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15738 - RNA, 357 nt, synthetic construct
  misc_feature 1..357: note = derived and/or modified sequence opt2 from IGF-IR_HUMAB-1A_HeavyChain
  source 1..357: mol_type = other RNA
gaggtccagctcgtccagtccggcggcggcctcgtccaccccggcggctccctccgcctctcctgcgccggctccggcttcaccttccgcaactacgccatgtactgggtccgccaggcccccggcaagggcctcgagtgggtctccgccatcggctccggcggcggcacctactacgccgactccgtcaagggccgcttcaccatctcccgcgacaacgccaagaactccctctacctccagatgaactccctccgcgccgaggacatggccgtctactactgcgcccgcgcccccaactggggctccgacgccttcgacatctggggccagggcaccatggtcaccgtctcctcc

SEQ ID NO: 15739 - RNA, 357 nt, synthetic construct
  misc_feature 1..357: note = derived and/or modified sequence opt2 from IGF-IR_HUMAB-23_HeavyChain
  source 1..357: mol_type = other RNA
gaggtccagctcgtccagtccggcggcggcctcgtccaccccggcggctccctccgcctctcctgcgccggctccggcttcaccttctccaactacgccatgtactgggtccgccaggcccccggcaagggcctcgagtgggtctccgccatcggctccggcggcggcacctactacgccgactccgtcaagggccgcttcaccatctcccgcgacaacgccaagaactccctctacctccagatgaactccctccgcgccgaggacatggccgtctaccactgcgcccgcgcccccaactggggctccgaggccttcgacatctggggccagggcaccatggtcaccgtctcctcc

SEQ ID NO: 15740 - RNA, 321 nt, synthetic construct; identical to SEQ ID NO: 15636
  misc_feature 1..321: note = derived and/or modified sequence opt2 from IGF-IR_HUMAB-23_LightChain
  source 1..321: mol_type = other RNA

SEQ ID NO: 15741 - RNA, 357 nt, synthetic construct
  misc_feature 1..357: note = derived and/or modified sequence opt2 from IGF-IR_HUMAB-8_HeavyChain
  source 1..357: mol_type = other RNA
gaggtccagctcgtccagtccggcggcggcctcgtccaccccggcggctccctccgcctctcctgcgccggctccggcttcaccttccgctcctacgccatgtactgggtccgccaggcccccggcaagggcctcgagtgggtctccgccatcggctccggcggcggcacctactacgccgactccgtcaagggccgcttcaccatctcccgcgacaacgccaagaactccctctacctccagatgaactccctccgcgccgaggacatggccgtctactactgcgcccgcgcccccaactggggctccgacgccttcgacatctggggccagggcaccatggtcaccgtctcctcc

SEQ ID NO: 15742 - RNA, 321 nt, synthetic construct
  misc_feature 1..321: note = derived and/or modified sequence opt2 from IGF-IR_HUMAB-8_LightChain
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccccccaccttcggccccggcaccaaggtcgacatcaag

SEQ ID NO: 15743 - RNA, 708 nt, synthetic construct
  misc_feature 1..708: note = derived and/or modified sequence opt2 from ImAb1_LightChain
  source 1..708: mol_type = other RNA
atggacatgcgcgcccccgcccagttcttcggcatcctcctcctctggttccccggcatccgctgcgacatcaagatgacccagtccccctcctccatgtacgcctccctcggcgagcgcgtcaccatcacctgcaaggcctcccaggacatcaagtcctacctctcctggtaccagcagaagccctggaagtcccccaagatcctcatctactacgccacctccctcgccgacggcgtcccctcccgcatctccggctccggctccggccaggactactccctcaccatctcctccctcgagtccgacgacaccgccacctactactgcctccagcacggcgagtccccctacaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15744 - RNA, 681 nt, synthetic construct
  misc_feature 1..681: note = derived and/or modified sequence opt2 from ImAb1_gamma1-Chain
  source 1..681: mol_type = other RNA
atgaacttcggcttctccctcatcttcctcgtcctcgtcctcaagggcgtccagtgcgaggtcaagctcgtcgagtccggcggcggcctcgtcaagcccggcggctccctcaagctctcctgcgccgcctccggcttcaccttctccaactacgccatgtcctgggtccgccagacccccgagaagcgcctcgagtgggtcgcctccatctcctccgacggcgacacctacttccccgacaacgtcaagggccgcttcaccatctcccgcgagaacgccggcaacatcctcttcctccagatgtcctccctccgctccgaggacaccgccatgtactactgcgcccgcggcttcatgatcaccttctggggccagggcaccctcgtcaccgtctccgccgccaagaccacccccccctccgtctaccccctcgcccccggctgcggcgacaccaccggctcctccgtcaccctcggctgcctcgtcaagggctacttccccgagtccgtcaccgtcacctggaactccggctccctctcctcctccgtccacaccttccccgccctcctccagtccggcctctacaccatgtcctcctccgtcaccgtcccctcctccacctggccctcccagaccgtcacctgctccgtcgcccaccccgcctcctccaccaccgtcgac

SEQ ID NO: 15745 - RNA, 1344 nt, synthetic construct
  misc_feature 1..1344: note = derived and/or modified sequence opt2 from Imalumab_HeavyChain1
  source 1..1344: mol_type = other RNA
gaggtccagctcctcgagtccggcggcggcctcgtccagcccggcggctccctccgcctctcctgcgccgcctccggcttcaccttctccatctactccatgaactgggtccgccaggcccccggcaagggcctcgagtgggtctcctccatcggctcctccggcggcaccacctactacgccgactccgtcaagggccgcttcaccatctcccgcgacaactccaagaacaccctctacctccagatgaactccctccgcgccgaggacaccgccgtctactactgcgccggctcccagtggctctacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15746 - RNA, 642 nt, synthetic construct
  misc_feature 1..642: note = derived and/or modified sequence opt2 from Imalumab_LightChain1
  source 1..642: mol_type = other RNA
gacatccagatgacccagtccccctcctccctctccgcctccgtcggcgaccgcgtcaccatcacctgccgctcctcccagcgcatcatgacctacctcaactggtaccagcagaagcccggcaaggcccccaagctcctcatcttcgtcgcctcccactcccagtccggcgtcccctcccgcttccgcggctccggctccgagaccgacttcaccctcaccatctccggcctccagcccgaggactccgccacctactactgccagcagtccttctggacccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15747 - RNA, 1347 nt, synthetic construct
  misc_feature 1..1347: note = derived and/or modified sequence opt2 from Imgatuzumab_HeavyChain1
  source 1..1347: mol_type = other RNA
caggtccagctcgtccagtccggcgccgaggtcaagaagcccggctcctccgtcaaggtctcctgcaaggcctccggcttcaccttcaccgactacaagatccactgggtccgccaggcccccggccagggcctcgagtggatgggctacttcaaccccaactccggctactccacctacgcccagaagttccagggccgcgtcaccatcaccgccgacaagtccacctccaccgcctacatggagctctcctccctccgctccgaggacaccgccgtctactactgcgcccgcctctcccccggcggctactacgtcatggacgcctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15748 - RNA, 639 nt, synthetic construct
  misc_feature 1..639: note = derived and/or modified sequence opt2 from Imgatuzumab_LightChain1
  source 1..639: mol_type = other RNA
gacatccagatgacccagtccccctcctccctctccgcctccgtcggcgaccgcgtcaccatcacctgccgcgcctcccagggcatcaacaactacctcaactggtaccagcagaagcccggcaaggcccccaagcgcctcatctacaacaccaacaacctccagaccggcgtcccctcccgcttctccggctccggctccggcaccgagttcaccctcaccatctcctccctccagcccgaggacttcgccacctactactgcctccagcacaactccttccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15749 - RNA, 1353 nt, synthetic construct
  misc_feature 1..1353: note = derived and/or modified sequence opt2 from Inclacumab_HeavyChain1
  source 1..1353: mol_type = other RNA
gaggtccagctcgtcgagtccggcggcggcctcgtccgccccggcggctccctccgcctctcctgcgccgcctccggcttcaccttctccaactacgacatgcactgggtccgccaggccaccggcaagggcctcgagtgggtctccgccatcaccgccgccggcgacatctactaccccggctccgtcaagggccgcttcaccatctcccgcgagaacgccaagaactccctctacctccagatgaactccctccgcgccggcgacaccgccgtctactactgcgcccgcggccgctactccggctccggctcctactacaacgactggttcgacccctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcgagggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15750 - RNA, 642 nt, synthetic construct
  misc_feature 1..642: note = derived and/or modified sequence opt2 from Inclacumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15751 - RNA, 1347 nt, synthetic construct
  misc_feature 1..1347: note = derived and/or modified sequence opt2 from Indatuximab_ravtansine_HeavyChain1
  source 1..1347: mol_type = other RNA
caggtccagctccagcagtccggctccgagctcatgatgcccggcgcctccgtcaagatctcctgcaaggccaccggctacaccttctccaactactggatcgagtgggtcaagcagcgccccggccacggcctcgagtggatcggcgagatcctccccggcaccggccgcaccatctacaacgagaagttcaagggcaaggccaccttcaccgccgacatctcctccaacaccgtccagatgcagctctcctccctcacctccgaggactccgccgtctactactgcgcccgccgcgactactacggcaacttctactacgccatggactactggggccagggcacctccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15752 - RNA, 642 nt, synthetic construct
  misc_feature 1..642: note = derived and/or modified sequence opt2 from Indatuximab_ravtansine_LightChain1
  source 1..642: mol_type = other RNA
gacatccagatgacccagtccacctcctccctctccgcctccctcggcgaccgcgtcaccatctcctgctccgcctcccagggcatcaacaactacctcaactggtaccagcagaagcccgacggcaccgtcgagctcctcatctactacacctccaccctccagtccggcgtcccctcccgcttctccggctccggctccggcaccgactactccctcaccatctccaacctcgagcccgaggacatcggcacctactactgccagcagtactccaagctcccccgcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15753 - RNA, 1347 nt, synthetic construct
  misc_feature 1..1347: note = derived and/or modified sequence opt2 from Indusatumab_vedotin_HeavyChain1
  source 1..1347: mol_type = other RNA
caggtccagctccagcagtggggcgccggcctcctcaagccctccgagaccctctccctcacctgcgccgtcttcggcggctccttctccggctactactggtcctggatccgccagccccccggcaagggcctcgagtggatcggcgagatcaaccaccgcggcaacaccaacgacaacccctccctcaagtcccgcgtcaccatctccgtcgacacctccaagaaccagttcgccctcaagctctcctccgtcaccgccgccgacaccgccgtctactactgcgcccgcgagcgcggctacacctacggcaacttcgaccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15754 - RNA, 642 nt, synthetic construct
  misc_feature 1..642: note = derived and/or modified sequence opt2 from Indusatumab_vedotin_LightChain1
  source 1..642: mol_type = other RNA
gagatcgtcatgacccagtcccccgccaccctctccgtctcccccggcgagcgcgccaccctctcctgccgcgcctcccagtccgtctcccgcaacctcgcctggtaccagcagaagcccggccaggccccccgcctcctcatctacggcgcctccacccgcgccaccggcatccccgcccgcttctccggctccggctccggcaccgagttcaccctcaccatcggctccctccagtccgaggacttcgccgtctactactgccagcagtacaagacctggccccgcaccttcggccagggcaccaacgtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15755 - RNA, 1353 nt, synthetic construct
  misc_feature 1..1353: note = derived and/or modified sequence opt2 from Inebilizumab_HeavyChain1
  source 1..1353: mol_type = other RNA
gaggtccagctcgtcgagtccggcggcggcctcgtccagcccggcggctccctccgcctctcctgcgccgcctccggcttcaccttctcctcctcctggatgaactgggtccgccaggcccccggcaagggcctcgagtgggtcggccgcatctaccccggcgacggcgacaccaactacaacgtcaagttcaagggccgcttcaccatctcccgcgacgactccaagaactccctctacctccagatgaactccctcaagaccgaggacaccgccgtctactactgcgcccgctccggcttcatcaccaccgtccgcgacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15756 - RNA, 654 nt, synthetic construct
  misc_feature 1..654: note = derived and/or modified sequence opt2 from Inebilizumab_LightChain1
  source 1..654: mol_type = other RNA
gagatcgtcctcacccagtcccccgacttccagtccgtcacccccaaggagaaggtcaccatcacctgccgcgcctccgagtccgtcgacaccttcggcatctccttcatgaactggttccagcagaagcccgaccagtcccccaagctcctcatccacgaggcctccaaccagggctccggcgtcccctcccgcttctccggctccggctccggcaccgacttcaccctcaccatcaactccctcgaggccgaggacgccgccacctactactgccagcagtccaaggaggtccccttcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15757 - RNA, 90 nt, synthetic construct
  misc_feature 1..90: note = derived and/or modified sequence opt2 from Insulin_peglispro_Fragment1
  source 1..90: mol_type = other RNA
ttcgtcaaccagcacctctgcggctcccacctcgtcgaggccctctacctcgtctgcggcgagcgcggcttcttctacaccaagcccacc

SEQ ID NO: 15758 - RNA, 63 nt, synthetic construct
  misc_feature 1..63: note = derived and/or modified sequence opt2 from Insulin_peglispro_Fragment2
  source 1..63: mol_type = other RNA
ggcatcgtcgagcagtgctgcacctccatctgctccctctaccagctcgagaactactgcaac

SEQ ID NO: 15759 - RNA, 495 nt, synthetic construct
  misc_feature 1..495: note = derived and/or modified sequence opt2 from Interferon_beta-1b_chain1
  source 1..495: mol_type = other RNA
tcctacaacctcctcggcttcctccagcgctcctccaacttccagtcccagaagctcctctggcagctcaacggccgcctcgagtactgcctcaaggaccgcatgaacttcgacatccccgaggagatcaagcagctccagcagttccagaaggaggacgccgccctcaccatctacgagatgctccagaacatcttcgccatcttccgccaggactcctcctccaccggctggaacgagaccatcgtcgagaacctcctcgccaacgtctaccaccagatcaaccacctcaagaccgtcctcgaggagaagctcgagaaggaggacttcacccgcggcaagctcatgtcctccctccacctcaagcgctactacggccgcatcctccactacctcaaggccaaggagtactcccactgcgcctggaccatcgtccgcgtcgagatcctccgcaacttctacttcatcaaccgcctcaccggctacctccgcaac

SEQ ID NO: 15760 - RNA, 1347 nt, synthetic construct
  misc_feature 1..1347: note = derived and/or modified sequence opt2 from Intetumumab_HeavyChain1
  source 1..1347: mol_type = other RNA
caggtccagctcgtcgagtccggcggcggcgtcgtccagcccggccgctcccgccgcctctcctgcgccgcctccggcttcaccttctcccgctacaccatgcactgggtccgccaggcccccggcaagggcctcgagtgggtcgccgtcatctccttcgacggctccaacaagtactacgtcgactccgtcaagggccgcttcaccatctcccgcgacaactccgagaacaccctctacctccaggtcaacatcctccgcgccgaggacaccgccgtctactactgcgcccgcgaggcccgcggctcctacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15761 - RNA, 645 nt, synthetic construct
  misc_feature 1..645: note = derived and/or modified sequence opt2 from Intetumumab_LightChain1
  source 1..645: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15762 - RNA, 1347 nt, synthetic construct; identical to SEQ ID NO: 15620
  misc_feature 1..1347: note = derived and/or modified sequence opt2 from Iodine_(124I)_Girentuximab_HeavyChain1
  source 1..1347: mol_type = other RNA

SEQ ID NO: 15763 - RNA, 642 nt, synthetic construct; identical to SEQ ID NO: 15621
  misc_feature 1..642: note = derived and/or modified sequence opt2 from Iodine_(124I)_Girentuximab_LightChain1
  source 1..642: mol_type = other RNA

SEQ ID NO: 15764 - RNA, 1335 nt, synthetic construct
  misc_feature 1..1335: note = derived and/or modified sequence opt2 from Iodine_(131I)_derlotuxiab_biotin_HeavyChain1
  source 1..1335: mol_type = other RNA
caggtccagctcaaggagtccggccccggcctcgtcgccccctcccagtccctctccatcacctgcaccgtctccggcttctccctcaccgactacggcgtccgctggatccgccagccccccggcaagggcctcgagtggctcggcgtcatctggggcggcggctccacctactacaactccgccctcaagtcccgcctctccatctccaaggacaactccaagtcccaggtcttcctcaagaactccctccagaccgacgacaccgcctactactgcgccaaggagaagcgccgcggctactactacgccgactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 15765 - RNA, 639 nt, synthetic construct
  misc_feature 1..639: note = derived and/or modified sequence opt2 from Iodine_(131I)_derlotuxiab_biotin_LightChain1
  source 1..639: mol_type = other RNA
gagaacgtcctcacccagtcccccgccatctccgcctcccccggcgagaaggtcaccacctgccgcgcctcctcctccgtctcctcctcctacctccactggtaccagcagaagtccggcgcctcccccaagctctggatctactccacctccaacctcgcctccggcgtccccgcccgcttctccggctccggctccggcacctcctactccctcaccatctcctccgtcgaggccgaggacgccgccacctactactgccagcagtactccggctaccccctcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15766 - RNA, 1350 nt, synthetic construct
  misc_feature 1..1350: note = derived and/or modified sequence opt2 from Iodine_(131I)_Derlotuximab_biotin_HeavyChain1
  source 1..1350: mol_type = other RNA
caggtccagctcaaggagtccggccccggcctcgtcgccccctcccagtccctctccatcacctgcaccgtctccggcttctccctcaccgactacggcgtccgctggatccgccagccccccggcaagggcctcgagtggctcggcgtcatctggggcggcggctccacctactacaactccgccctcaagtcccgcctctccatctccaaggacaactccaagtcccaggtcttcctcaagatgaactccctccagaccgacgacaccgccatgtactactgcgccaaggagaagcgccgcggctactactacgccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15767 - RNA, 645 nt, synthetic construct
  misc_feature 1..645: note = derived and/or modified sequence opt2 from Iodine_(131I)_Derlotuximab_biotin_LightChain1
  source 1..645: mol_type = other RNA
gagaacgtcctcacccagtcccccgccatcatgtccgcctcccccggcgagaaggtcaccatgacctgccgcgcctcctcctccgtctcctcctcctacctccactggtaccagcagaagtccggcgcctcccccaagctctggatctactccacctccaacctcgcctccggcgtccccgcccgcttctccggctccggctccggcacctcctactccctcaccatctcctccgtcgaggccgaggacgccgccacctactactgccagcagtactccggctaccccctcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15768 - RNA, 1344 nt, synthetic construct
  misc_feature 1..1344: note = derived and/or modified sequence opt2 from Ipilimumab_HeavyChain
  source 1..1344: mol_type = other RNA
caggtccagctcgtcgagtccggcggcggcgtcgtccagcccggccgctccctccgcctctcctgcgccgcctccggcttcaccttctcctcctacaccatgcactgggtccgccaggcccccggcaagggcctcgagtgggtcaccttcatctcctacgacggcaacaacaagtactacgccgactccgtcaagggccgcttcaccatctcccgcgacaactccaagaacaccctctacctccagatgaactccctccgcgccgaggacaccgccatctactactgcgcccgcaccggctggctcggccccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15769 - RNA, 645 nt, synthetic construct
  misc_feature 1..645: note = derived and/or modified sequence opt2 from Ipilimumab_LightChain
  source 1..645: mol_type = other RNA
gagatcgtcctcacccagtcccccggcaccctctccctctcccccggcgagcgcgccaccctctcctgccgcgcctcccagtccgtcggctcctcctacctcgcctggtaccagcagaagcccggccaggccccccgcctcctcatctacggcgccttctcccgcgccaccggcatccccgaccgcttctccggctccggctccggcaccgacttcaccctcaccatctcccgcctcgagcccgaggacttcgccgtctactactgccagcagtacggctcctccccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15770 - RNA, 186 nt, synthetic construct
  misc_feature 1..186: note = derived and/or modified sequence opt2 from Iratumumab_HeavyChain1
  source 1..186: mol_type = other RNA
caggtccagctccagcagtggggcgccggcctcctcaagccctccgagaccctctccctcacctgcgccgtctacggcggctccttctccgcctactactggtcctggatccgccagccccccggcaagggcctcgagtggatcggcgactactggggccagggctccctcgtcaccgtctcctcc

SEQ ID NO: 15771 - RNA, 321 nt, synthetic construct
  misc_feature 1..321: note = derived and/or modified sequence opt2 from Iratumumab_LightChain1
  source 1..321: mol_type = other RNA
gacatccagatgacccagtcccccacctccctctccgcctccgtcggcgaccgcgtcaccatcacctgccgcgcctcccagggcatctcctcctggctcacctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacgactcctaccccatcaccttcggccagggcacccgcctcgagatcaag

SEQ ID NO: 15772 - RNA, 1350 nt, synthetic construct
  misc_feature 1..1350: note = derived and/or modified sequence opt2 from Isatuximab_HeavyChain1
  source 1..1350: mol_type = other RNA
caggtccagctcgtccagtccggcgccgaggtcgccaagcccggcacctccgtcaagctctcctgcaaggcctccggctacaccttcaccgactactggatgcagtgggtcaagcagcgccccggccagggcctcgagtggatcggcaccatctaccccggcgacggcgacaccggctacgcccagaagttccagggcaaggccaccctcaccgccgacaagtcctccaagaccgtctacatgcacctctcctccctcgcctccgaggactccgccgtctactactgcgcccgcggcgactactacggctccaactccctcgactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15773 - RNA, 642 nt, synthetic construct
  misc_feature 1..642: note = derived and/or modified sequence opt2 from Isatuximab_LightChain1
  source 1..642: mol_type = other RNA
gacatcgtcatgacccagtcccacctctccatgtccacctccctcggcgaccccgtctccatcacctgcaaggcctcccaggacgtctccaccgtcgtcgcctggtaccagcagaagcccggccagtccccccgccgcctcatctactccgcctcctaccgctacatcggcgtccccgaccgcttcaccggctccggcgccggcaccgacttcaccttcaccatctcctccgtccaggccgaggacctcgccgtctactactgccagcagcactactcccccccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15774 - RNA, 1347 nt, synthetic construct
  misc_feature 1..1347: note = derived and/or modified sequence opt2 from Itolizumab_HeavyChain1
  source 1..1347: mol_type = other RNA
gaggtccagctcgtcgagtccggcggcggcctcgtcaagcccggcggctccctcaagctctcctgcgccgcctccggcttcaagttctcccgctacgccatgtcctgggtccgccaggcccccggcaagcgcctcgagtgggtcgccaccatctcctccggcggctcctacatctactaccccgactccgtcaagggccgcttcaccatctcccgcgacaacgtcaagaacaccctctacctccagatgtcctccctccgctccgaggacaccgccatgtactactgcgcccgccgcgactacgacctcgactacttcgactcctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15775 - RNA, 642 nt, synthetic construct
  misc_feature 1..642: note = derived and/or modified sequence opt2 from Itolizumab_LightChain1
  source 1..642: mol_type = other RNA
gacatccagatgacccagtccccctcctccctctccgcctccgtcggcgaccgcgtcaccatcacctgcaaggcctcccgcgacatccgctcctacctcacctggtaccagcagaagcccggcaaggcccccaagaccctcatctactacgccacctccctcgccgacggcgtcccctcccgcttctccggctccggctccggccaggactactccctcaccatctcctccctcgagtccgacgacaccgccacctactactgcctccagcacggcgagtcccccttcaccctcggctccggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15776 - RNA, 1335 nt, synthetic construct
  misc_feature 1..1335: note = derived and/or modified sequence opt2 from Ixekizumab_HeavyChain1
  source 1..1335: mol_type = other RNA
caggtccagctcgtccagtccggcgccgaggtcaagaagcccggctcctccgtcaaggtctcctgcaaggcctccggctactccttcaccgactaccacatccactgggtccgccaggcccccggccagggcctcgagtggatgggcgtcatcaaccccatgtacggcaccaccgactacaaccagcgcttcaagggccgcgtcaccatcaccgccgacgagtccacctccaccgcctacatggagctctcctccctccgctccgaggacaccgccgtctactactgcgcccgctacgactacttcaccggcaccggcgtctactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15777 - RNA, 657 nt, synthetic construct
  misc_feature 1..657: note = derived and/or modified sequence opt2 from Ixekizumab_LightChain1
  source 1..657: mol_type = other RNA
gacatcgtcatgacccagacccccctctccctctccgtcacccccggccagcccgcctccatctcctgccgctcctcccgctccctcgtccactcccgcggcaacacctacctccactggtacctccagaagcccggccagtccccccagctcctcatctacaaggtctccaaccgcttcatcggcgtccccgaccgcttctccggctccggctccggcaccgacttcaccctcaagatctcccgcgtcgaggccgaggacgtcggcgtctactactgctcccagtccacccacctccccttcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15778 - RNA, 1347 nt, synthetic construct
  misc_feature 1..1347: note = derived and/or modified sequence opt2 from Labetuzumab_govitecan_HeavyChain1
  source 1..1347: mol_type = other RNA
gaggtccagctcgtcgagtccggcggcggcgtcgtccagcccggccgctccctccgcctctcctgctccgcctccggcttcgacttcaccacctactggatgtcctgggtccgccaggcccccggcaagggcctcgagtggatcggcgagatccaccccgactcctccaccatcaactacgccccctccctcaaggaccgcttcaccatctcccgcgacaacgccaagaacaccctcttcctccagatggactccctccgccccgaggacaccggcgtctacttctgcgcctccctctacttcggcttcccctggttcgcctactggggccagggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15779 - RNA, 639 nt, synthetic construct
  misc_feature 1..639: note = derived and/or modified sequence opt2 from Labetuzumab_govitecan_LightChain1
  source 1..639: mol_type = other RNA
gacatccagctcacccagtccccctcctccctctccgcctccgtcggcgaccgcgtcaccatcacctgcaaggcctcccaggacgtcggcacctccgtcgcctggtaccagcagaagcccggcaaggcccccaagctcctcatctactggacctccacccgccacaccggcgtcccctcccgcttctccggctccggctccggcaccgacttcaccttcaccatctcctccctccagcccgaggacatcgccacctactactgccagcagtactccctctaccgctccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15780 - RNA, 1341 nt, synthetic construct
  misc_feature 1..1341: note = derived and/or modified sequence opt2 from Lambrolizumab_HeavyChain1
  source 1..1341: mol_type = other RNA
caggtccagctcgtccagtccggcgtcgaggtcaagaagcccggcgcctccgtcaaggtctcctgcaaggcctccggctacaccttcaccaactactacatgtactgggtccgccaggcccccggccagggcctcgagtggatgggcggcatcaacccctccaacggcggcaccaacttcaacgagaagttcaagaaccgcgtcaccctcaccaccgactcctccaccaccaccgcctacatggagctcaagtccctccagttcgacgacaccgccgtctactactgcgcccgccgcgactaccgcttcgacatgggcttcgactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15781 - RNA, 654 nt, synthetic construct
  misc_feature 1..654: note = derived and/or modified sequence opt2 from Lambrolizumab_LightChain1
  source 1..654: mol_type = other RNA
gagatcgtcctcacccagtcccccgccaccctctccctctcccccggcgagcgcgccaccctctcctgccgcgcctccaagggcgtctccacctccggctactcctacctccactggtaccagcagaagcccggccaggccccccgcctcctcatctacctcgcctcctacctcgagtccggcgtccccgcccgcttctccggctccggctccggcaccgacttcaccctcaccatctcctccctcgagcccgaggacttcgccgtctactactgccagcactcccgcgacctccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15782 - RNA, 669 nt, synthetic construct
  misc_feature 1..669: note = derived and/or modified sequence opt2 from Lampalizumab_HeavyChain1
  source 1..669: mol_type = other RNA
gaggtccagctcgtccagtccggccccgagctcaagaagcccggcgcctccgtcaaggtctcctgcaaggcctccggctacaccttcaccaactacggcatgaactgggtccgccaggcccccggccagggcctcgagtggatgggctggatcaacacctacaccggcgagaccacctacgccgacgacttcaagggccgcttcgtcttctccctcgacacctccgtctccaccgcctacctccagatctcctccctcaaggccgaggacaccgccgtctactactgcgagcgcgagggcggcgtcaacaactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacc

SEQ ID NO: 15783 - RNA, 642 nt, synthetic construct
  misc_feature 1..642: note = derived and/or modified sequence opt2 from Lampalizumab_LightChain1
  source 1..642: mol_type = other RNA
gacatccaggtcacccagtccccctcctccctctccgcctccgtcggcgaccgcgtcaccatcacctgcatcacctccaccgacatcgacgacgacatgaactggtaccagcagaagcccggcaaggtccccaagctcctcatctccggcggcaacaccctccgccccggcgtcccctcccgcttctccggctccggctccggcaccgacttcaccctcaccatctcctccctccagcccgaggacgtcgccacctactactgcctccagtccgactccctcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15784 - RNA, 1353 nt, synthetic construct
  misc_feature 1..1353: note = derived and/or modified sequence opt2 from Lanadelumab_HeavyChain1
  source 1..1353: mol_type = other RNA
gaggtccagctcctcgagtccggcggcggcctcgtccagcccggcggctccctccgcctctcctgcgccgcctccggcttcaccttctcccactacatcatgatgtgggtccgccaggcccccggcaagggcctcgagtgggtctccggcatctactcctccggcggcatcaccgtctacgccgactccgtcaagggccgcttcaccatctcccgcgacaactccaagaacaccctctacctccagatgaactccctccgcgccgaggacaccgccgtctactactgcgcctaccgccgcatcggcgtcccccgccgcgacgagttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15785 - RNA, 639 nt, synthetic construct
  misc_feature 1..639: note = derived and/or modified sequence opt2 from Lanadelumab_LightChain1
  source 1..639: mol_type = other RNA
gacatccagatgacccagtccccctccaccctctccgcctccgtcggcgaccgcgtcaccatcacctgccgcgcctcccagtccatctcctcctggctcgcctggtaccagcagaagcccggcaaggcccccaagctcctcatctacaaggcctccaccctcgagtccggcgtcccctcccgcttctccggctccggctccggcaccgagttcaccctcaccatctcctccctccagcccgacgacttcgccacctactactgccagcagtacaacacctactggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15786 - RNA, 1317 nt, synthetic construct
  misc_feature 1..1317: note = derived and/or modified sequence opt2 from Landogrozumab_HeavyChain1
  source 1..1317: mol_type = other RNA
gaggtccagctcgtcgagtccggcggcggcctcgtccagcccggcggctccctccgcctctcctgcgccgcctccggcctcaccttctcccgctaccccatgtcctgggtccgccaggcccccggcaagggcctcgtctgggtctccgccatcacctcctccggcggctccacctactactccgacaccgtcaagggccgcttcaccatctcccgcgacaacgccaagaacaccctctacctccagatgaactccctccgcgccgaggacaccgccgtctactactgcgcccgcctccccgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 15787 - RNA, 645 nt, synthetic construct
  misc_feature 1..645: note = derived and/or modified sequence opt2 from Landogrozumab_LightChain1
  source 1..645: mol_type = other RNA
gagatcgtcctcacccagtcccccggcaccctctccctctcccccggcgagcgcgccaccctctcctgccgcgcctcctcctccgtctcctcctcctacctccactggtaccagcagaagcccggccaggccccccgcctcctcatctactccacctccaacctcgtcgccggcatccccgaccgcttctccggctccggctccggcaccgacttcaccctcaccatctcccgcctcgagcccgaggacttcgccgtctactactgccagcaccactccggctaccacttcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15788 - RNA, 1344 nt, synthetic construct
  misc_feature 1..1344: note = derived and/or modified sequence opt2 from Laprituximab_emtansine_HeavyChain1
  source 1..1344: mol_type = other RNA
caggtccagctcgtccagtccggcgccgaggtcgccaagcccggcgcctccgtcaagctctcctgcaaggcctccggctacaccttcacctcctactggatgcagtgggtcaagcagcgccccggccagggcctcgagtgcatcggcaccatctaccccggcgacggcgacaccacctacacccagaagttccagggcaaggccaccctcaccgccgacaagtcctcctccaccgcctacatgcagctctcctccctccgctccgaggactccgccgtctactactgcgcccgctacgacgcccccggctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15789 - RNA, 642 nt, synthetic construct
  misc_feature 1..642: note = derived and/or modified sequence opt2 from Laprituximab_emtansine_LightChain1
  source 1..642: mol_type = other RNA
gacatccagatgacccagtccccctcctccctctccgcctccgtcggcgaccgcgtcaccatcacctgccgcgcctcccaggacatcaacaactacctcgcctggtaccagcacaagcccggcaagggccccaagctcctcatccactacacctccaccctccaccccggcatcccctcccgcttctccggctccggctccggccgcgactactccttctccatctcctccctcgagcccgaggacatcgccacctactactgcctccagtacgacaacctcctctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15790 - RNA, 1314 nt, synthetic construct
  misc_feature 1..1314: note = derived and/or modified sequence opt2 from Lealesoab_HeavyChain1
  source 1..1314: mol_type = other RNA
caggtccagctccaggagtccggccccgagctcaagaagcccggcgagaccgtcaagatctcctgcaaggcctccggctacaccttccgcaactacggcaactgggtcaagcaggcccccggcaagggcctcaagtggggctggatcaacacctacaccggcgagcccacctacgccgacgacttcaagggccgcttcgccttctccctcgagacctccgcctccaccgcctacctccagatcaacaacgtcaagaacgaggacaccgccacctacttctgcgcccgcaagggctgggacttcaacggctcctccctcgactactggggccagggcaccaccgtcaccgtctcctccgccaagaccacccccccctccgtctaccccctcgcccccggctccgccgcccagaccaactccgtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccccccgcccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctggttcgtcgacgacgtcgaggtccacaccgcccagacccagccccgcgaggagcagttcaactccaccttccgctccgtctccgagctccccatccaccaggactggctcaacggcaaggagttcaagtgccgcgtcaactccgccgccttccccgcccccatcgagaagaccatctccaagaccaagggccgccccaaggccccccaggtctacaccatccccccccccaaggagcaggccaaggacaaggtctccctcacctgcatcaccgacttcttccccgaggacatcaccgtcgagtggcagtggaacggccagcccgccgagaactacaagaacacccagcccatcaacaccaacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 15791 - RNA, 654 nt, synthetic construct
  misc_feature 1..654: note = derived and/or modified sequence opt2 from Lealesoab_LightChain1
  source 1..654: mol_type = other RNA
gacatccagctcacccagacccccctctccctccccgtctccctcggcgaccaggcctccatctcctgccgctcctcccagtccatcgtccactccaacggcaacacctacctcgagtggtacctccagaagcccggccagtcccccaacctcctcatctacaaggtctccaaccgcttctccggcgtccccgaccgcttctccggctccggctccggcaccgacttcaccctcaagatctcccgcgtcgaggccgaggacctcggcgtctactactgcttccagggctcccacgtcccccccaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactcctcctccaccctcaccctcaccaaggacgagtacgagcgccacaactcctacacctgcgaggccacccacaagacctccacctcccccatcgtcaagtccttcaaccgcaacgagtgc

SEQ ID NO: 15792 - RNA, 1335 nt, synthetic construct
  misc_feature 1..1335: note = derived and/or modified sequence opt2 from Lebrikizumab_HeavyChain1
  source 1..1335: mol_type = other RNA
caggtcaccctccgcgagtccggccccgccctcgtcaagcccacccagaccctcaccctcacctgcaccgtctccggcttctccctctccgcctactccgtcaactggatccgccagccccccggcaaggccctcgagtggctcgccatgatctggggcgacggcaagatcgtctacaactccgccctcaagtcccgcctcaccatctccaaggacacctccaagaaccaggtcgtcctcaccatgaccaacatggaccccgtcgacaccgccacctactactgcgccggcgacggctactacccctacgccatggacaactggggccagggctccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15793 - RNA, 654 nt, synthetic construct
  misc_feature 1..654: note = derived and/or modified sequence opt2 from Lebrikizumab_LightChain1
  source 1..654: mol_type = other RNA
gacatcgtcatgacccagtcccccgactccctctccgtctccctcggcgagcgcgccaccatcaactgccgcgcctccaagtccgtcgactcctacggcaactccttcatgcactggtaccagcagaagcccggccagccccccaagctcctcatctacctcgcctccaacctcgagtccggcgtccccgaccgcttctccggctccggctccggcaccgacttcaccctcaccatctcctccctccaggccgaggacgtcgccgtctactactgccagcagaacaacgaggacccccgcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15794 - RNA, 1227 nt, synthetic construct
  misc_feature 1..1227: note = derived and/or modified sequence opt2 from Lenercept_chain1
  source 1..1227: mol_type = other RNA
ctcgtcccccacctcggcgaccgcgagaagcgcgactccgtctgcccccagggcaagtacatccacccccagaacaactccatctgctgcaccaagtgccacaagggcacctacctctacaacgactgccccggccccggccaggacaccgactgccgcgagtgcgagtccggctccttcaccgcctccgagaaccacctccgccactgcctctcctgctccaagtgccgcaaggagatgggccaggtcgagatctcctcctgcaccgtcgaccgcgacaccgtctgcggctgccgcaagaaccagtaccgccactactggtccgagaacctcttccagtgcttcaactgctccctctgcctcaacggcaccgtccacctctcctgccaggagaagcagaacaccgtctgcacctgccacgccggcttcttcctccgcgagaacgagtgcgtctcctgctccaactgcaagaagtccctcgagtgcaccaagctctgcctcccccagatcgagaacgtcaagggcaccgaggactccggcaccaccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15795 - RNA, 1347 nt, synthetic construct
  misc_feature 1..1347: note = derived and/or modified sequence opt2 from Lenzilumab_HeavyChain1
  source 1..1347: mol_type = other RNA
caggtccagctcgtccagtccggcgccgaggtcaagaagcccggcgcctccgtcaaggtctcctgcaaggcctccggctactccttcaccaactactacatccactgggtccgccaggcccccggccagcgcctcgagtggatgggctggatcaacgccggcaacggcaacaccaagtactcccagaagttccagggccgcgtcaccatcacccgcgacacctccgcctccaccgcctacatggagctctcctccctccgctccgaggacaccgccgtctactactgcgtccgccgccagcgcttcccctactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15796 - RNA, 642 nt, synthetic construct
  misc_feature 1..642: note = derived and/or modified sequence opt2 from Lenzilumab_LightChain1
  source 1..642: mol_type = other RNA
gagatcgtcctcacccagtcccccgccaccctctccgtctcccccggcgagcgcgccaccctctcctgccgcgcctcccagtccgtcggcaccaacgtcgcctggtaccagcagaagcccggccaggccccccgcgtcctcatctactccacctcctcccgcgccaccggcatcaccgaccgcttctccggctccggctccggcaccgacttcaccctcaccatctcccgcctcgagcccgaggacttcgccgtctactactgccagcagttcaacaagtcccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15797 - RNA, 1326 nt, synthetic construct
  misc_feature 1..1326: note = derived and/or modified sequence opt2 from Lerdelimumab_HeavyChain1
  source 1..1326: mol_type = other RNA
gaggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctggtacgacggctccaacaagtactacgccgactccgtcaagggccgcttcaccatctcccgcgacaactccaagaacaccctctacctccagatggactccctccgcgccgaggacaccgccgtctactactgcggccgcaccctcgagtcctccctctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15798 - RNA, 645 nt, synthetic construct
  misc_feature 1..645: note = derived and/or modified sequence opt2 from Lerdelimumab_LightChain1
  source 1..645: mol_type = other RNA
tcctccgagctcacccaggaccccgccgtctccgtcgccctcggccagaccgtccgcatcacctgccagggcgactccctccgctcctactacgcctcctggtaccagcagaagcccggccaggcccccgtcctcgtcatctacggcaagaacaaccgcccctccggcatccccgaccgcttctccggctcctcctccggcaacaccgcctccctcaccatcaccggcgcccaggccgaggacgaggccgactactactgcaactcccgcgactcctcctccacccaccgcggcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15799 - RNA, 1353 nt, synthetic construct
  misc_feature 1..1353: note = derived and/or modified sequence opt2 from Lexatumumab_HeavyChain1
  source 1..1353: mol_type = other RNA
gaggtccagctcgtccagtccggcggcggcgtcgagcgccccggcggctccctccgcctctcctgcgccgcctccggcttcaccttcgacgactacggcatgtcctgggtccgccaggcccccggcaagggcctcgagtgggtctccggcatcaactggaacggcggctccaccggctacgccgactccgtcaagggccgcgtcaccatctcccgcgacaacgccaagaactccctctacctccagatgaactccctccgcgccgaggacaccgccgtctactactgcgccaagatcctcggcgccggccgcggctggtacttcgacctctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15800 - RNA, 1353 nt, synthetic construct; identical to SEQ ID NO: 15799
  misc_feature 1..1353: note = derived and/or modified sequence opt2 from Lexatumumab_HeavyChain
  source 1..1353: mol_type = other RNA

SEQ ID NO: 15801 - RNA, 642 nt, synthetic construct
  misc_feature 1..642: note = derived and/or modified sequence opt2 from Lexatumumab_LightChain1
  source 1..642: mol_type = other RNA
tcctccgagctcacccaggaccccgccgtctccgtcgccctcggccagaccgtccgcatcacctgccagggcgactccctccgctcctactacgcctcctggtaccagcagaagcccggccaggcccccgtcctcgtcatctacggcaagaacaaccgcccctccggcatccccgaccgcttctccggctcctcctccggcaacaccgcctccctcaccatcaccggcgcccaggccgaggacgaggccgactactactgcaactcccgcgactcctccggcaaccacgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15802 - RNA, 642 nt, synthetic construct; identical to SEQ ID NO: 15801
  misc_feature 1..642: note = derived and/or modified sequence opt2 from Lexatumumab_LightChain
  source 1..642: mol_type = other RNA

SEQ ID NO: 15803 - RNA, 1377 nt, synthetic construct
  misc_feature 1..1377: note = derived and/or modified sequence opt2 from Libivirumab_HeavyChain1
  source 1..1377: mol_type = other RNA
caggtccagctcgtcgagtccggcggcggcgtcgtccgccccggccgctccctccgcctctcctgcgccgcctccggcttcgccttctccgactactccatcaactgggtccgccaggcccccggcaagggcctcgagtgggtcgccatcatctcctacgacggccgcatcacctactaccgcgactccgtcaagggccgcttcaccatctcccgcgacgactccaagaacaccctctacctccagatgaactccctccgcaccgaggacaccgccgtctactactgcgcccgccagtactacgacttctggtccggctcctccgtcggccgcaactacgacggcatggacgtctggggcctcggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15804 - RNA, 657 nt, synthetic construct
  misc_feature 1..657: note = derived and/or modified sequence opt2 from Libivirumab_LightChain1
  source 1..657: mol_type = other RNA
gacatcgtcatgacccagtcccccctctccctctccgtcacccccggcgagcccgcctccatctcctgccgctcctcccagtccctcctccaccgctccggcaacaactacctcgactggtacctccagaagcccggccactccccccagctcctcatctacgtcggctccaaccgcgcctccggcgtccccgaccgcttctccggctccggctccggcaccgagtacaccctcaagatctcccgcgtcgaggccgaggacgtcggcgtctactactgcatgcaggccctccagaccccccgcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15805 - RNA, 1350 nt, synthetic construct
  misc_feature 1..1350: note = derived and/or modified sequence opt2 from Lifastuzumab_HeavyChain
  source 1..1350: mol_type = other RNA
gaggtccagctcgtcgagtccggcggcggcctcgtccagcccggcggctccctccgcctctcctgcgccgcctccggcttctccttctccgacttcgccatgtcctgggtccgccaggcccccggcaagggcctcgagtgggtcgccaccatcggccgcgtcgccttccacacctactaccccgactccatgaagggccgcttcaccatctcccgcgacaactccaagaacaccctctacctccagatgaactccctccgcgccgaggacaccgccgtctactactgcgcccgccaccgcggcttcgacgtcggccacttcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15806 - RNA, 657 nt, synthetic construct
  misc_feature 1..657: note = derived and/or modified sequence opt2 from Lifastuzumab_LightChain
  source 1..657: mol_type = other RNA
gacatccagatgacccagtccccctcctccctctccgcctccgtcggcgaccgcgtcaccatcacctgccgctcctccgagaccctcgtccactcctccggcaacacctacctcgagtggtaccagcagaagcccggcaaggcccccaagctcctcatctaccgcgtctccaaccgcttctccggcgtcccctcccgcttctccggctccggctccggcaccgacttcaccctcaccatctcctccctccagcccgaggacttcgccacctactactgcttccagggctccttcaaccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15807 - RNA, 1347 nt, synthetic construct
  misc_feature 1..1347: note = derived and/or modified sequence opt2 from Lifastuzumab_vedotin_HeavyChain1
  source 1..1347: mol_type = other RNA
gtccagctcgtcgagtccggcggcggcctcgtccagcccggcggctccctccgcctctcctgcgccgcctccggcttctccttctccgacttcgccatgtcctgggtccgccaggcccccggcaagggcctcgagtgggtcgccaccatcggccgcgtcgccttccacacctactaccccgactccatgaagggccgcttcaccatctcccgcgacaactccaagaacaccctctacctccagatgaactccctccgcgccgaggacaccgccgtctactactgcgcccgccaccgcggcttcgacgtcggccacttcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15808 - RNA, 657 nt, synthetic construct; identical to SEQ ID NO: 15806
  misc_feature 1..657: note = derived and/or modified sequence opt2 from Lifastuzumab_vedotin_LightChain1
  source 1..657: mol_type = other RNA

SEQ ID NO: 15809 - RNA, 1359 nt, synthetic construct
  misc_feature 1..1359: note = derived and/or modified sequence opt2 from Ligelizumab_HeavyChain1
  source 1..1359: mol_type = other RNA
caggtccagctcgtccagtccggcgccgaggtcatgaagcccggctcctccgtcaaggtctcctgcaaggcctccggctacaccttctcctggtactggctcgagtgggtccgccaggcccccggccacggcctcgagtggatgggcgagatcgaccccggcaccttcaccaccaactacaacgagaagttcaaggcccgcgtcaccttcaccgccgacacctccacctccaccgcctacatggagctctcctccctccgctccgaggacaccgccgtctactactgcgcccgcttctcccacttctccggctccaactacgactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15810 - RNA, 642 nt, synthetic construct
  misc_feature 1..642: note = derived and/or modified sequence opt2 from Ligelizumab_LightChain1
  source 1..642: mol_type = other RNA
gagatcgtcatgacccagtcccccgccaccctctccgtctcccccggcgagcgcgccaccctctcctgccgcgcctcccagtccatcggcaccaacatccactggtaccagcagaagcccggccaggccccccgcctcctcatctactacgcctccgagtccatctccggcatccccgcccgcttctccggctccggctccggcaccgagttcaccctcaccatctcctccctccagtccgaggacttcgccgtctactactgccagcagtcctggtcctggcccaccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15811 - RNA, 1329 nt, synthetic construct; identical to SEQ ID NO: 15359
  misc_feature 1..1329: note = derived and/or modified sequence opt2 from Lilotomab_HeavyChain1
  source 1..1329: mol_type = other RNA

SEQ ID NO: 15812 - RNA, 642 nt, synthetic construct; identical to SEQ ID NO: 15360
  misc_feature 1..642: note = derived and/or modified sequence opt2 from Lilotomab_LightChain1
  source 1..642: mol_type = other RNA

SEQ ID NO: 15813 - RNA, 1338 nt, synthetic construct
  misc_feature 1..1338: note = derived and/or modified sequence opt2 from Lintuzumab_HeavyChain1
  source 1..1338: mol_type = other RNA
caggtccagctcgtccagtccggcgccgaggtcaagaagcccggctcctccgtcaaggtctcctgcaaggcctccggctacaccttcaccgactacaacatgcactgggtccgccaggcccccggccagggcctcgagtggatcggctacatctacccctacaacggcggcaccggctacaaccagaagttcaagtccaaggccaccatcaccgccgacgagtccaccaacaccgcctacatggagctctcctccctccgctccgaggacaccgccgtctactactgcgcccgcggccgccccgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15814 - RNA, 654 nt, synthetic construct
  misc_feature 1..654: note = derived and/or modified sequence opt2 from Lintuzumab_LightChain1
  source 1..654: mol_type = other RNA
gacatccagatgacccagtccccctcctccctctccgcctccgtcggcgaccgcgtcaccatcacctgccgcgcctccgagtccgtcgacaactacggcatctccttcatgaactggttccagcagaagcccggcaaggcccccaagctcctcatctacgccgcctccaaccagggctccggcgtcccctcccgcttctccggctccggctccggcaccgacttcaccctcaccatctcctccctccagcccgacgacttcgccacctactactgccagcagtccaaggaggtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15815 - RNA, 1350 nt, synthetic construct
  misc_feature 1..1350: note = derived and/or modified sequence opt2 from Lirilumab_HeavyChain1
  source 1..1350: mol_type = other RNA
caggtccagctcgtccagtccggcgccgaggtcaagaagcccggctcctccgtcaaggtctcctgcaaggcctccggcggcaccttctccttctacgccatctcctgggtccgccaggcccccggccagggcctcgagtggatgggcggcttcatccccatcttcggcgccgccaactacgcccagaagttccagggccgcgtcaccatcaccgccgacgagtccacctccaccgcctacatggagctctcctccctccgctccgacgacaccgccgtctactactgcgcccgcatcccctccggctcctactactacgactacgacatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15816 - RNA, 642 nt, synthetic construct
  misc_feature 1..642: note = derived and/or modified sequence opt2 from Lirilumab_LightChain1
  source 1..642: mol_type = other RNA
gagatcgtcctcacccagtcccccgtcaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggatgtacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15817 - RNA, 1344 nt, synthetic construct
  misc_feature 1..1344: note = derived and/or modified sequence opt2 from Lodelcizumab_HeavyChain1
  source 1..1344: mol_type = other RNA
caggtccagctcgtccagtccggcgccgaggtcaagaagcccggcgcctccgtcaaggtctcctgcaaggcctccggctacaccttctccaccatgtacatgtcctgggtccgccaggcccccggccagggcctcgagtggatgggccgcatcgaccccgccaacgagcacaccaactacgcccagaagttccagggccgcgtcaccatgacccgcgacacctccatctccaccgcctacatggagctctcccgcctcacctccgacgacaccgccgtctactactgcgcccgctcctactactactacaacatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15818 - RNA, 639 nt, synthetic construct
  misc_feature 1..639: note = derived and/or modified sequence opt2 from Lodelcizumab_LightChain1
  source 1..639: mol_type = other RNA
cagatcgtcctcacccagtcccccgccaccctctccgtctcccccggcgagcgcgccaccctctcctgccgcgcctcccagtccgtctcctacatgcactggtaccagcagaagcccggccaggccccccgcctcctcatctacggcgtcttccgccgcgccaccggcatccccgaccgcttctccggctccggctccggcaccgacttcaccctcaccatcggccgcctcgagcccgaggacttcgccgtctactactgcctccagtggtcctccgacccccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15819 - RNA, 1356 nt, synthetic construct
  misc_feature 1..1356: note = derived and/or modified sequence opt2 from Lokivetmab_HeavyChain1
  source 1..1356: mol_type = other RNA
gaggtccagctcgtcgagtccggcggcgacctcgtcaagcccggcggctccctccgcctctcctgcgtcgcctccggcttcaccttctccaactacggcatgtcctgggtccgccaggcccccggcaagggcctccagtgggtcgccaccatctcctacggcggctcctacacctactaccccgacaacatcaagggccgcttcaccatctcccgcgacaacgccaagaacaccctctacctccagatgaactccctccgcgccgaggacaccgccatgtactactgcgtccgcggctacggctacgacaccatggactactggggccagggcaccctcgtcaccgtctcctccgcctccaccaccgccccctccgtcttccccctcgccccctcctgcggctccacctccggctccaccgtcgccctcgcctgcctcgtctccggctacttccccgagcccgtcaccgtctcctggaactccggctccctcacctccggcgtccacaccttcccctccgtcctccagtcctccggcctctactccctctcctccatggtcaccgtcccctcctcccgctggccctccgagaccttcacctgcaacgtcgcccaccccgcctccaagaccaaggtcgacaagcccgtccccaagcgcgagaacggccgcgtcccccgcccccccgactgccccaagtgccccgcccccgagatgctcggcggcccctccgtcttcatcttcccccccaagcccaaggacaccctcctcatcgcccgcacccccgaggtcacctgcgtcgtcgtcgacctcgaccccgaggaccccgaggtccagatctcctggttcgtcgacggcaagcagatgcagaccgccaagacccagccccgcgaggagcagttcaacggcacctaccgcgtcgtctccgtcctccccatcggccaccaggactggctcaagggcaagcagttcacctgcaaggtcaacaacaaggccctcccctcccccatcgagcgcaccatctccaaggcccgcggccaggcccaccagccctccgtctacgtcctccccccctcccgcgaggagctctccaagaacaccgtctccctcacctgcctcatcaaggacttcttcccccccgacatcgacgtcgagtggcagtccaacggccagcaggagcccgagtccaagtaccgcaccacccccccccagctcgacgaggacggctcctacttcctctactccaagctctccgtcgacaagtcccgctggcagcgcggcgacaccttcatctgcgccgtcatgcacgaggccctccacaaccactacacccaggagtccctctcccactcccccggc

SEQ ID NO: 15820 - RNA, 651 nt, synthetic construct
  misc_feature 1..651: note = derived and/or modified sequence opt2 from Lokivetmab_LightChain1
  source 1..651: mol_type = other RNA
gagatcgtcatgacccagtcccccgcctccctctccctctcccaggaggagaaggtcaccatcacctgcaaggcctcccagtccgtctccttcgccggcaccggcctcatgcactggtaccagcagaagcccggccaggcccccaagctcctcatctaccgcgcctccaacctcgaggccggcgtcccctcccgcttctccggctccggctccggcaccgacttctccttcaccatctcctccctcgagcccgaggacgtcgccgtctactactgccagcagtcccgcgagtacccctggaccttcggccagggcaccaagctcgagatcaagcgcaacgacgcccagcccgccgtctacctcttccagccctcccccgaccagctccacaccggctccgcctccgtcgtctgcctcctcaactccttctaccccaaggacatcaacgtcaagtggaaggtcgacggcgtcatccaggacaccggcatccaggagtccgtcaccgagcaggacaaggactccacctactccctctcctccaccctcaccatgtcctccaccgagtacctctcccacgagctctactcctgcgagatcacccacaagtccctcccctccaccctcatcaagtccttccagcgctccgagtgc

SEQ ID NO: 15821 - RNA, 1344 nt, synthetic construct
  misc_feature 1..1344: note = derived and/or modified sequence opt2 from Lorvotuzumab_mertansine_HeavyChain1
  source 1..1344: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgcctacatctcctccggctccttcaccatctactacgccgactccgtcaagggccgcttcaccatctcccgcgacaactccaagaacaccctctacctccagatgaactccctccgcgccgaggacaccgccgtctactactgcgcccgcatgcgcaagggctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15822 - RNA, 657 nt, synthetic construct
  misc_feature 1..657: note = derived and/or modified sequence opt2 from Lorvotuzumab_mertansine_LightChain1
  source 1..657: mol_type = other RNA
gacgtcgtcatgacccagtcccccctctccctccccgtcaccctcggccagcccgcctccatctcctgccgctcctcccagatcatcatccactccgacggcaacacctacctcgagtggttccagcagcgccccggccagtccccccgccgcctcatctacaaggtctccaaccgcttctccggcgtccccgaccgcttctccggctccggctccggcaccgacttcaccctcaagatctcccgcgtcgaggccgaggacgtcggcgtctactactgcttccagggctcccacgtcccccacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15823 - RNA, 336 nt, synthetic construct
  misc_feature 1..336: note = derived and/or modified sequence opt2 from Lpathomab_VL
  source 1..336: mol_type = other RNA
gacgtcgtcatgacccagacccccctctccctccccgtctccctcggcgaccaggcctccatctcctgcacctccggccagtccctcgtccacatcaacggcaacacctacctccactggtacctccagaagcccggccagtcccccaagctcctcatctacaaggtctccaacctcttctccggcgtccccgaccgcttctccggctccggctccggcaccgacttcaccctcaagatctcccgcgtcgaggccgaggacctcggcgtctacttctgctcccagtccacccacttccccttcaccttcggcaccggcaccaagctcgagatcaag

SEQ ID NO: 15824 - RNA, 366 nt, synthetic construct
  misc_feature 1..366: note = derived and/or modified sequence opt2 from Lpathomab_gamma1-Chain_VDJ-Region
  source 1..366: mol_type = other RNA
caggtccagctccagcagtccggcgccgagctcgtccgccccggcacctccgtcaaggtctcctgcaaggcctccggctacggcttcatcaactacctcatcgagtggatcaagcagcgccccggccagggcctcgagtggatcggcctcatcaaccccggctccgactacaccaactacaacgagaacttcaagggcaaggccaccctcaccgccgacaagtcctcctccaccgcctacatgcacctctcctccctcacctccgaggactccgccgtctacttctgcgcccgccgcttcggctactacggctccggcaactacttcgactactggggccagggcaccaccctcaccgtctcctcc

SEQ ID NO: 15825 - RNA, 1350 nt, synthetic construct
  misc_feature 1..1350: note = derived and/or modified sequence opt2 from Lucatumumab_HeavyChain1
  source 1..1350: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgaggagtccaaccgctaccacgccgactccgtcaagggccgcttcaccatctcccgcgacaactccaagatcaccctctacctccagatgaactccctccgcaccgaggacaccgccgtctactactgcgcccgcgacggcggcatcgccgcccccggccccgactactggggccagggcaccctcgtcaccgtctcctccgcctccaccaagggcccctccgtcttccccctcgcccccgcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15826 - RNA, 657 nt, synthetic construct
  misc_feature 1..657: note = derived and/or modified sequence opt2 from Lucatumumab_LightChain1
  source 1..657: mol_type = other RNA
gacatcgtcatgacccagtcccccctctccctcaccgtcacccccggcgagcccgcctccatctcctgccgctcctcccagtccctcctctactccaacggctacaactacctcgactggtacctccagaagcccggccagtccccccaggtcctcatctccctcggctccaaccgcgcctccggcgtccccgaccgcttctccggctccggctccggcaccgacttcaccctcaagatctcccgcgtcgaggccgaggacgtcggcgtctactactgcatgcaggcccgccagacccccttcaccttcggccccggcaccaaggtcgacatccgccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15827 - RNA, 324 nt, synthetic construct
  misc_feature 1..324: note = derived and/or modified sequence opt2 from Lulizumab_pegol_LightChain1
  source 1..324: mol_type = other RNA
gacatccagatgacccagtccccctcctccctctccgcctccgtcggcgaccgcgtcaccatcacctgccgcgcctcccgccccatctggcccttcctcgagtggtaccagcagaagcccggcaaggcccccaagctcctcatctacttcacctcccgcctccgccacggcgtcccctcccgcttctccggctccggctccggcacctgcttcaccctcaccatctcctccctccagcccgaggacttcgccacctactactgcctccagaacgtcgccaaccccgccaccttctcccagggcaccaaggtcgagatcaagcgc

SEQ ID NO: 15828 - RNA, 324 nt, synthetic construct; identical to SEQ ID NO: 15827
  misc_feature 1..324: note = derived and/or modified sequence opt2 from Lulizumab_pegol_LightChain
  source 1..324: mol_type = other RNA

SEQ ID NO: 15829 - RNA, 1194 nt, synthetic construct
  misc_feature 1..1194: note = derived and/or modified sequence opt2 from Lumiliximab_HeavyChain1
  source 1..1194: mol_type = other RNA
gaggtccagctcgtcgagtccggcggcggcctcgccaagcccggcggctccctccgcctctcctgcgccgcctccggcttccgcttcaccttcaacaactactacatggactgggtccgccaggcccccggccagggcctcgagtgggtcctcaccaccggctccgactcctggggccagggcgtcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15830 - RNA, 642 nt, synthetic construct
  misc_feature 1..642: note = derived and/or modified sequence opt2 from Lumiliximab_LightChain1
  source 1..642: mol_type = other RNA
gacatccagatgacccagtccccctcctccctctccgcctccgtcggcgaccgcgtcaccatcacctgccgcgcctcccaggacatccgctactacctcaactggtaccagcagaagcccggcaaggcccccaagctcctcatctacgtcgcctcctccctccagtccggcgtcccctcccgcttctccggctccggctccggcaccgagttcaccctcaccgtctcctccctccagcccgaggacttcgccacctactactgcctccaggtctactccaccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15831 - RNA, 1347 nt, synthetic construct
  misc_feature 1..1347: note = derived and/or modified sequence opt2 from Lumretuzumab_HeavyChain1
  source 1..1347: mol_type = other RNA
caggtccagctcgtccagtccggcgccgaggtcaagaagcccggcgcctccgtcaaggtctcctgcaaggcctccggctacaccttccgctcctcctacatctcctgggtccgccaggcccccggccagggcctcgagtggatgggctggatctacgccggcaccggctccccctcctacaaccagaagctccagggccgcgtcaccatgaccaccgacacctccacctccaccgcctacatggagctccgctccctccgctccgacgacaccgccgtctactactgcgcccgccaccgcgactactactccaactccctcacctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15832 - RNA, 660 nt, synthetic construct
  misc_feature 1..660: note = derived and/or modified sequence opt2 from Lumretuzumab_LightChain1
  source 1..660: mol_type = other RNA
gacatcgtcatgacccagtcccccgactccctcgccgtctccctcggcgagcgcgccaccatcaactgcaagtcctcccagtccgtcctcaactccggcaaccagaagaactacctcacctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagtccgactactcctacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15833 - RNA, 1329 nt, synthetic construct; identical to SEQ ID NO: 15359
  misc_feature 1..1329: note = derived and/or modified sequence opt2 from Lutetium_(177Lu)_lilotomab_satetraxetan_HeavyChain1
  source 1..1329: mol_type = other RNA

SEQ ID NO: 15834 - RNA, 642 nt, synthetic construct; identical to SEQ ID NO: 15360
  misc_feature 1..642: note = derived and/or modified sequence opt2 from Lutetium_(177Lu)_lilotomab_satetraxetan_LightChain1
  source 1..642: mol_type = other RNA

SEQ ID NO: 15835 - RNA, 1350 nt, synthetic construct
  misc_feature 1..1350: note = derived and/or modified sequence opt2 from Margetuximab_HeavyChain1
  source 1..1350: mol_type = other RNA
caggtccagctccagcagtccggccccgagctcgtcaagcccggcgcctccctcaagctctcctgcaccgcctccggcttcaacatcaaggacacctacatccactgggtcaagcagcgccccgagcagggcctcgagtggatcggccgcatctaccccaccaacggctacacccgctacgaccccaagttccaggacaaggccaccatcaccgccgacacctcctccaacaccgcctacctccaggtctcccgcctcacctccgaggacaccgccgtctactactgctcccgctggggcggcgacggcttctacgccatggactactggggccagggcgcctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcgtcggcggcccctccgtcttcctcctcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccccgaggagcagtacaactccaccctccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccacccccctcgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15836 - RNA, 642 nt, synthetic construct
  misc_feature 1..642: note = derived and/or modified sequence opt2 from Margetuximab_LightChain1
  source 1..642: mol_type = other RNA
gacatcgtcatgacccagtcccacaagttcatgtccacctccgtcggcgaccgcgtctccatcacctgcaaggcctcccaggacgtcaacaccgccgtcgcctggtaccagcagaagcccggccactcccccaagctcctcatctactccgcctccttccgctacaccggcgtccccgaccgcttcaccggctcccgctccggcaccgacttcaccttcaccatctcctccgtccaggccgaggacctcgccgtctactactgccagcagcactacaccaccccccccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15837 - RNA, 762 nt, synthetic construct
  misc_feature 1..762: note = derived and/or modified sequence opt2 from Marzeptacog_alfa_HeavyChain1
  source 1..762: mol_type = other RNA
atcgtcggcggcaaggtctgccccaagggcgagtgcccctggcaggtcctcctcctcgtcaacggcgcccagctctgcggcggcaccctcatcaacaccatctgggtcgtctccgccgcccactgcttcgacaagatcaagaactggcgcaacctcatcgccgtcctcggcgagcacgacctctccgagcacgacggcgacgagcagtcccgccgcgtcgcccaggtcatcatcccctccacctacgtccccggcaccaccaaccacgacatcgccctcctccgcctccaccagcccgtcgtcctcaccgaccacgtcgtccccctctgcctccccgagcgcaccttctccgagcgcaccctcgccttcgtccgcttctccctcgtctccggctggggccgcctcctcgaccgcggcgccaccgccctcgagctccaggtcctcaacgtcccccgcctcatgacccaggactgcctccagcagtcccgcaaggtcggcgactcccccaacatcaccgagtacatgttctgcgccggctactccgacggctccaaggactcctgcaagggcgactccggcggcccccacgccacccactaccgcggcacctggtacctcaccggcatcgtctcctggggccagggctgcgccaccgtcggccacttcggcgtctacacccgcgtctcccagtacatcgagtggctccagaagctcatgcgctccgagccccgccccggcgtcctcctccgcgcccccttcccc

SEQ ID NO: 15838 - RNA, 456 nt, synthetic construct
  misc_feature 1..456: note = derived and/or modified sequence opt2 from Marzeptacog_alfa_LightChain1
  source 1..456: mol_type = other RNA
gccaacgccttcctcgaggagctccgccccggctccctcgagcgcgagtgcaaggaggagcagtgctccttcgaggaggcccgcgagatcttcaaggacgccgagcgcaccaagctcttctggatctcctactccgacggcgaccagtgcgcctcctccccctgccagaacggcggctcctgcaaggaccagctccagtcctacatctgcttctgcctccccgccttcgagggccgcaactgcgagacccacaaggacgaccagctcatctgcgtcaacgagaacggcggctgcgagcagtactgctccgaccacaccggcaccaagcgctcctgccgctgccacgagggctactccctcctcgccgacggcgtctcctgcaacgccaccgtcgagtacccctgcggcaagatccccatcctcgagaagcgcaacgcctccaagccccagggccgc

SEQ ID NO: 15839 - RNA, 669 nt, synthetic construct
  misc_feature 1..669: note = derived and/or modified sequence opt2 from Matuzumab_HeavyChain1_variant_3c08_H
  source 1..669: mol_type = other RNA
caggtccagctcgtccagtccggcgccgaggtcaagaagcccggcgcctccgtcaaggtctcctgcaaggcctccggctacaccttcacctcccactggatgcactgggtccgccaggcccccggccagggcctcgagtggatcggcgagttcaacccctccaacggccgcaccaactacaacgagaagttcaagtccaaggccaccatgaccgtcgacacctccaccaacaccgcctacatggagctctcctccctccgctccgaggacaccgccgtctactactgcgcctcccgcgactacgactacgacggccgctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcc

SEQ ID NO: 15840 - RNA, 669 nt, synthetic construct
  misc_feature 1..669: note = derived and/or modified sequence opt2 from Matuzumab_HeavyChain1_variant_3c09_C
  source 1..669: mol_type = other RNA
caggtccagctcgtccagtccggcgccgaggtcaagaagcccggcgcctccgtcaaggtctcctgcaaggcctccggctacaccttcacctcccactggatgcactgggtccgccaggcccccggccagggcctcgagtggatcggcgagttcaacccctccaacggccgcaccaactacaacgagaagttcaagtccaaggccaccatgaccgtcgacacctccaccaacaccgcctacatggagctctcctccctccgctccgaggacaccgccgtctactactgcgcctcccgcgactacgactacgccggccgctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcc

SEQ ID NO: 15841 - RNA, 636 nt, synthetic construct
  misc_feature 1..636: note = derived and/or modified sequence opt2 from Matuzumab_LightChain1_variant_3c08_L
  source 1..636: mol_type = other RNA
gacatccagatgacccagtccccctcctccctctccgcctccgtcggcgaccgcgtcaccatcacctgctccgcctcctcctccgtcacctacatgtactggtaccagcagaagcccggcaaggcccccaagctcctcatctacgacacctccaacctcgcctccggcgtcccctcccgcttctccggctccggctccggcaccgactacaccttcaccatctcctccctccagcccgaggacatcgccacctactactgccagcagtggtcctcccacatcttcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgag

SEQ ID NO: 15842 - RNA, 636 nt, synthetic construct; identical to SEQ ID NO: 15841
  misc_feature 1..636: note = derived and/or modified sequence opt2 from Matuzumab_LightChain1_variant_3c09_B
  source 1..636: mol_type = other RNA

SEQ ID NO: 15843 - RNA, 1341 nt, synthetic construct
  misc_feature 1..1341: note = derived and/or modified sequence opt2 from Mavrilimumab_HeavyChain1
  source 1..1341: mol_type = other RNA
caggtccagctcgtccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgaccccgaggagaacgagatcgtctacgcccagcgcttccagggccgcgtcaccatgaccgaggacacctccaccgacaccgcctacatggagctctcctccctccgctccgaggacaccgccgtctactactgcgccatcgtcggctccttctcccccctcaccctcggcctctggggccagggcaccatggtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15844 - RNA, 651 nt, synthetic construct
  misc_feature 1..651: note = derived and/or modified sequence opt2 from Mavrilimumab_LightChain1
  source 1..651: mol_type = other RNA
cagtccgtcctcacccagcccccctccgtctccggcgcccccggccagcgcgtcaccatctcctgcaccggctccggctccaacatcggcgccccctacgacgtctcctggtaccagcagctccccggcaccgcccccaagctcctcatctaccacaacaacaagcgcccctccggcgtccccgaccgcttctccggctccaagtccggcacctccgcctccctcgccatcaccggcctccaggccgaggacgaggccgactactactgcgccaccgtcgaggccggcctctccggctccgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15845 - RNA, 1359 nt, synthetic construct
  misc_feature 1..1359: note = derived and/or modified sequence opt2 from MDX-1303_HeavyChain1
  source 1..1359: mol_type = other RNA
caggtccagctcgtcgagtccggcggcggcgtcgtccagcccggccgctccctccgcctctcctgcgccgcctccggcttcaccttctcctactacggcatgcactgggtccgccaggcccccggcaagggcctcgagtgggtcgccgtcatctggcacgacgagtccatcgtctactacgccgactccgtcaagggccgcttcaccatctcccgcgacaactccaagaacaccctctacctccagatgaactccctccgcgccgaggacaccgccgtctactactgcacccgcgaccccggcgacccctactactactactacggcctcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15846 - RNA, 645 nt, synthetic construct
  misc_feature 1..645: note = derived and/or modified sequence opt2 from MDX-1303_LightChain1
  source 1..645: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccatgtacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15847 - RNA, 1347 nt, synthetic construct
  misc_feature 1..1347: note = derived and/or modified sequence opt2 from Mepolizumab_HeavyChain1
  source 1..1347: mol_type = other RNA
caggtcaccctccgcgagtccggccccgccctcgtcaagcccacccagaccctcaccctcacctgcaccgtctccggcttctccctcacctcctactccgtccactgggtccgccagccccccggcaagggcctcgagtggctcggcgtcatctgggcctccggcggcaccgactacaactccgccctcatgtcccgcctctccatctccaaggacacctcccgcaaccaggtcgtcctcaccatgaccaacatggaccccgtcgacaccgccacctactactgcgcccgcgaccccccctcctccctcctccgcctcgactactggggccgcggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15848 - RNA, 660 nt, synthetic construct
  misc_feature 1..660: note = derived and/or modified sequence opt2 from Mepolizumab_LightChain1
  source 1..660: mol_type = other RNA
gacatcgtcatgacccagtcccccgactccctcgccgtctccctcggcgagcgcgccaccatcaactgcaagtcctcccagtccctcctcaactccggcaaccagaagaactacctcgcctggtaccagcagaagcccggccagccccccaagctcctcatctacggcgcctccacccgcgagtccggcgtccccgaccgcttctccggctccggctccggcaccgacttcaccctcaccatctcctccctccaggccgaggacgtcgccgtctactactgccagaacgtccactccttccccttcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15849 - RNA, 1350 nt, synthetic construct
  misc_feature 1..1350: note = derived and/or modified sequence opt2 from Metelimumab_HeavyChain1
  source 1..1350: mol_type = other RNA
gaggtccagctcgtcgagtccggcggcggcgtcgtccagcccggccgctccctccgcctctcctgcgccgcctccggcttcaccttctcctcctacggcatgcactgggtccgccaggcccccggcaaggagctcgagtgggtcgccgtcatctcctacgacggctccatcaagtactacgccgactccgtcaagggccgcttcaccatctcccgcgacaactccaagaacaccctctacctccagatgaactccctccgcgccgaggacaccgccgtctactactgcgcccgcaccggcgagtactccggctacgacaccgacccccagtactcctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaagcccaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15850 - RNA, 639 nt, synthetic construct
  misc_feature 1..639: note = derived and/or modified sequence opt2 from Metelimumab_LightChain1
  source 1..639: mol_type = other RNA
gagatcgtcctcacccagtccccctcctccctctccgcctccgtcggcgaccgcgtcaccatcacctgccgcgcctcccagggcatcggcgacgacctcggctggtaccagcagaagcccggcaaggcccccatcctcctcatctacggcacctccaccctccagtccggcgtcccctcccgcttctccggctccggctccggcaccgacttcaccctcaccatcaactccctccagcccgaggacttcgccacctactactgcctccaggactccaactaccccctcaccttcggcggcggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcccccgtcaccaagtccttcaaccgcggcgagtgc

SEQ ID NO: 15851 - RNA, 1350 nt, synthetic construct
  misc_feature 1..1350: note = derived and/or modified sequence opt2 from Milatuzumab_HeavyChain1
  source 1..1350: mol_type = other RNA
caggtccagctccagcagtccggctccgagctcaagaagcccggcgcctccgtcaaggtctcctgcaaggcctccggctacaccttcaccaactacggcgtcaactggatcaagcaggcccccggccagggcctccagtggatgggctggatcaaccccaacaccggcgagcccaccttcgacgacgacttcaagggccgcttcgccttctccctcgacacctccgtctccaccgcctacctccagatctcctccctcaaggccgacgacaccgccgtctacttctgctcccgctcccgcggcaagaacgaggcctggttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15852 - RNA, 657 nt, synthetic construct
  misc_feature 1..657: note = derived and/or modified sequence opt2 from Milatuzumab_LightChain1
  source 1..657: mol_type = other RNA
gacatccagctcacccagtcccccctctccctccccgtcaccctcggccagcccgcctccatctcctgccgctcctcccagtccctcgtccaccgcaacggcaacacctacctccactggttccagcagcgccccggccagtccccccgcctcctcatctacaccgtctccaaccgcttctccggcgtccccgaccgcttctccggctccggctccggcaccgacttcaccctcaagatctcccgcgtcgaggccgaggacgtcggcgtctacttctgctcccagtcctcccacgtcccccccaccttcggcgccggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15853 - RNA, 1341 nt, synthetic construct
  misc_feature 1..1341: note = derived and/or modified sequence opt2 from Mirvetuximab_HeavyChain1
  source 1..1341: mol_type = other RNA
caggtccagctcgtccagtccggcgccgaggtcgtcaagcccggcgcctccgtcaagatctcctgcaaggcctccggctacaccttcaccggctacttcatgaactgggtcaagcagtcccccggccagtccctcgagtggatcggccgcatccacccctacgacggcgacaccttctacaaccagaagttccagggcaaggccaccctcaccgtcgacaagtcctccaacaccgcccacatggagctcctctccctcacctccgaggacttcgccgtctactactgcacccgctacgacggctcccgcgccatggactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15854 - RNA, 654 nt, synthetic construct
  misc_feature 1..654: note = derived and/or modified sequence opt2 from Mirvetuximab_LightChain1
  source 1..654: mol_type = other RNA
gacatcgtcctcacccagtcccccctctccctcgccgtctccctcggccagcccgccatcatctcctgcaaggcctcccagtccgtctccttcgccggcacctccctcatgcactggtaccaccagaagcccggccagcagccccgcctcctcatctaccgcgcctccaacctcgaggccggcgtccccgaccgcttctccggctccggctccaagaccgacttcaccctcaccatctcccccgtcgaggccgaggacgccgccacctactactgccagcagtcccgcgagtacccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15855 - RNA, 1344 nt, synthetic construct
  misc_feature 1..1344: note = derived and/or modified sequence opt2 from Modotuximab_HeavyChain1
  source 1..1344: mol_type = other RNA
caggtccagctccagcagcccggcgccgagctcgtcgagcccggcggctccgtcaagctctcctgcaaggcctccggctacaccttcacctcccactggatgcactgggtcaagcagcgccccggccagggcctcgagtggatcggcgagatcaacccctcctccggccgcaacaactacaacgagaagttcaagtccaaggccaccctcaccgtcgacaagtcctcctccaccgcctacatgcagttctcctccctcacctccgaggactccgccgtctactactgcgtccgctactacggctacgacgaggccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15856 - RNA, 657 nt, synthetic construct
  misc_feature 1..657: note = derived and/or modified sequence opt2 from Modotuximab_LightChain1
  source 1..657: mol_type = other RNA
gacatcgtcatgacccaggccgccttctccaaccccgtcaccctcggcacctccgcctccatctcctgccgctcctccaagtccctcctccactccaacggcatcacctacctctactggtacctccagaagcccggccagtccccccagctcctcatctaccagatgtccaacctcgcctccggcgtccccgaccgcttctcctcctccggctccggcaccgacttcaccctccgcatctcccgcgtcgaggccgaggacgtcggcgtctactactgcgcccagaacctcgagctcccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15857 - RNA, 1347 nt, synthetic construct
  misc_feature 1..1347: note = derived and/or modified sequence opt2 from Mogamulizumab_HeavyChain1
  source 1..1347: mol_type = other RNA
gaggtccagctcgtcgagtccggcggcgacctcgtccagcccggccgctccctccgcctctcctgcgccgcctccggcttcatcttctccaactacggcatgtcctgggtccgccaggcccccggcaagggcctcgagtgggtcgccaccatctcctccgcctccacctactcctactaccccgactccgtcaagggccgcttcaccatctcccgcgacaacgccaagaactccctctacctccagatgaactccctccgcgtcgaggacaccgccctctactactgcggccgccactccgacggcaacttcgccttcggctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15858 - RNA, 657 nt, synthetic construct
  misc_feature 1..657: note = derived and/or modified sequence opt2 from Mogamulizumab_LightChain1
  source 1..657: mol_type = other RNA
gacgtcctcatgacccagtcccccctctccctccccgtcacccccggcgagcccgcctccatctcctgccgctcctcccgcaacatcgtccacatcaacggcgacacctacctcgagtggtacctccagaagcccggccagtccccccagctcctcatctacaaggtctccaaccgcttctccggcgtccccgaccgcttctccggctccggctccggcaccgacttcaccctcaagatctcccgcgtcgaggccgaggacgtcggcgtctactactgcttccagggctccctcctcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15859 - RNA, 1356 nt, synthetic construct
  misc_feature 1..1356: note = derived and/or modified sequence opt2 from Monalizumab_HeavyChain1
  source 1..1356: mol_type = other RNA
caggtccagctcgtccagtccggcgccgaggtcaagaagcccggcgcctccgtcaaggtctcctgcaaggcctccggctacaccttcacctcctactggatgaactgggtccgccaggcccccggccagggcctcgagtggatgggccgcatcgacccctacgactccgagacccactacgcccagaagctccagggccgcgtcaccatgaccaccgacacctccacctccaccgcctacatggagctccgctccctccgctccgacgacaccgccgtctactactgcgcccgcggcggctacgacttcgacgtcggcaccctctactggttcttcgacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15860 - RNA, 642 nt, synthetic construct
  misc_feature 1..642: note = derived and/or modified sequence opt2 from Monalizumab_LightChain1
  source 1..642: mol_type = other RNA
gacatccagatgacccagtccccctcctccctctccgcctccgtcggcgaccgcgtcaccatcacctgccgcgcctccgagaacatctactcctacctcgcctggtaccagcagaagcccggcaaggcccccaagctcctcatctacaacgccaagaccctcgccgagggcgtcccctcccgcttctccggctccggctccggcaccgacttcaccctcaccatctcctccctccagcccgaggacttcgccacctactactgccagcaccactacggcaccccccgcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15861 - RNA, 1350 nt, synthetic construct
  misc_feature 1..1350: note = derived and/or modified sequence opt2 from Motavizumab_HeavyChain
  source 1..1350: mol_type = other RNA
caggtcaccctccgcgagtccggccccgccctcgtcaagcccacccagaccctcaccctcacctgcaccttctccggcttctccctctccaccgccggcatgtccgtcggctggatccgccagccccccggcaaggccctcgagtggctcgccgacatctggtgggacgacaagaagcactacaacccctccctcaaggaccgcctcaccatctccaaggacacctccaagaaccaggtcgtcctcaaggtcaccaacatggaccccgccgacaccgccacctactactgcgcccgcgacatgatcttcaacttctacttcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15862 - RNA, 1350 nt, synthetic construct; identical to SEQ ID NO: 15861
  misc_feature 1..1350: note = derived and/or modified sequence opt2 from Motavizumab_HeavyChain_variant
  source 1..1350: mol_type = other RNA

SEQ ID NO: 15863 - RNA, 639 nt, synthetic construct
  misc_feature 1..639: note = derived and/or modified sequence opt2 from Motavizumab_LightChain
  source 1..639: mol_type = other RNA
gacatccagatgacccagtccccctccaccctctccgcctccgtcggcgaccgcgtcaccatcacctgctccgcctcctcccgcgtcggctacatgcactggtaccagcagaagcccggcaaggcccccaagctcctcatctacgacacctccaagctcgcctccggcgtcccctcccgcttctccggctccggctccggcaccgagttcaccctcaccatctcctccctccagcccgacgacttcgccacctactactgcttccagggctccggctaccccttcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15864 - RNA, 639 nt, synthetic construct; identical to SEQ ID NO: 15863
  misc_feature 1..639: note = derived and/or modified sequence opt2 from Motavizumab_LightChain_variant
  source 1..639: mol_type = other RNA

SEQ ID NO: 15865 - RNA, 1428 nt, synthetic construct
  misc_feature 1..1428: note = derived and/or modified sequence opt2 from Moxetumomab_pasudotox_HeavyChain1
  source 1..1428: mol_type = other RNA
atggaggtccagctcgtcgagtccggcggcggcctcgtcaagcccggcggctccctcaagctctcctgcgccgcctccggcttcgccttctccatctacgacatgtcctgggtccgccagacccccgagaagtgcctcgagtgggtcgcctacatctcctccggcggcggcaccacctactaccccgacaccgtcaagggccgcttcaccatctcccgcgacaacgccaagaacaccctctacctccagatgtcctccctcaagtccgaggacaccgccatgtactactgcgcccgccactccggctacggcacccactggggcgtcctcttcgcctactggggccagggcaccctcgtcaccgtctccgccaaggcctccggcggccccgagggcggctccctcgccgccctcaccgcccaccaggcctgccacctccccctcgagaccttcacccgccaccgccagccccgcggctgggagcagctcgagcagtgcggctaccccgtccagcgcctcgtcgccctctacctcgccgcccgcctctcctggaaccaggtcgaccaggtcatccgcaacgccctcgcctcccccggctccggcggcgacctcggcgaggccatccgcgagcagcccgagcaggcccgcctcgccctcaccctcgccgccgccgagtccgagcgcttcgtccgccagggcaccggcaacgacgaggccggcgccgccaacggccccgccgactccggcgacgccctcctcgagcgcaactaccccaccggcgccgagttcctcggcgacggcggcgacgtctccttctccacccgcggcacccagaactggaccgtcgagcgcctcctccaggcccaccgccagctcgaggagcgcggctacgtcttcgtcggctaccacggcaccttcctcgaggccgcccagtccatcgtcttcggcggcgtccgcgcccgctcccaggacctcgacgccatctggcgcggcttctacatcgccggcgaccccgccctcgcctacggctacgcccaggaccaggagcccgacgcccgcggccgcatccgcaacggcgccctcctccgcgtctacgtcccccgctcctccctccccggcttctaccgcacctccctcaccctcgccgcccccgaggccgccggcgaggtcgagcgcctcatcggccaccccctccccctccgcctcgacgccatcaccggccccgaggaggagggcggccgcctcgagaccatcctcggctggcccctcgccgagcgcaccgtcgtcatcccctccgccatccccaccgacccccgcaacgtcggcggcgacctcgacccctcctccatccccgacaaggagcaggccatctccgccctccccgactacgcctcccagcccggcaagcccccccgcgaggacctcaag

SEQ ID NO: 15866 - RNA, 324 nt, synthetic construct
  misc_feature 1..324: note = derived and/or modified sequence opt2 from Moxetumomab_pasudotox_LightChain1
  source 1..324: mol_type = other RNA
atggacatccagatgacccagaccacctcctccctctccgcctccctcggcgaccgcgtcaccatctcctgccgcgcctcccaggacatctccaactacctcaactggtaccagcagaagcccgacggcaccgtcaagctcctcatctactacacctccatcctccactccggcgtcccctcccgcttctccggctccggctccggcaccgactactccctcaccatctccaacctcgagcaggaggacttcgccacctacttctgccagcagggcaacaccctcccctggaccttcggctgcggcaccaagctcgagatcaag

SEQ ID NO: 15867 - RNA, 1350 nt, synthetic construct
  misc_feature 1..1350: note = derived and/or modified sequence opt2 from Muromonab-CD3_HeavyChain
  source 1..1350: mol_type = other RNA
caggtccagctccagcagtccggcgccgagctcgcccgccccggcgcctccgtcaagatgtcctgcaaggcctccggctacaccttcacccgctacaccatgcactgggtcaagcagcgccccggccagggcctcgagtggatcggctacatcaacccctcccgcggctacaccaactacaaccagaagttcaaggacaaggccaccctcaccaccgacaagtcctcctccaccgcctacatgcagctctcctccctcacctccgaggactccgccgtctactactgcgcccgctactacgacgaccactactgcctcgactactggggccagggcaccaccctcaccgtctcctccgccaagaccaccgccccctccgtctaccccctcgcccccgtctgcggcggcaccaccggctcctccgtcaccctcggctgcctcgtcaagggctacttccccgagcccgtcaccctcacctggaactccggctccctctcctccggcgtccacaccttccccgccgtcctccagtccgacctctacaccctctcctcctccgtcaccgtcacctcctccacctggccctcccagtccatcacctgcaacgtcgcccaccccgcctcctccaccaaggtcgacaagaagatcgagccccgccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15868 - RNA, 639 nt, synthetic construct
  misc_feature 1..639: note = derived and/or modified sequence opt2 from Muromonab-CD3_LightChain
  source 1..639: mol_type = other RNA
cagatcgtcctcacccagtcccccgccatcatgtccgcctcccccggcgagaaggtcaccatgacctgctccgcctcctcctccgtctcctacatgaactggtaccagcagaagtccggcacctcccccaagcgctggatctacgacacctccaagctcgcctccggcgtccccgcccacttccgcggctccggctccggcacctcctactccctcaccatctccggcatggaggccgaggacgccgccacctactactgccagcagtggtcctccaaccccttcaccttcggctccggcaccaagctcgagatcaaccgcgccgacaccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15869 - RNA, 1347 nt, synthetic construct
  misc_feature 1..1347: note = derived and/or modified sequence opt2 from Namilumab_HeavyChain1
  source 1..1347: mol_type = other RNA
caggtccagctcgtccagtccggcgccgaggtcaagaagcccggcgcctccgtcaaggtctcctgcaaggccttcggctaccccttcaccgactacctcctccactgggtccgccaggcccccggccagggcctcgagtgggtcggctggctcaacccctactccggcgacaccaactacgcccagaagttccagggccgcgtcaccatgacccgcgacacctccatctccaccgcctacatggagctctcccgcctccgctccgacgacaccgccgtctactactgcacccgcaccaccctcatctccgtctacttcgactactggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15870 - RNA, 642 nt, synthetic construct
  misc_feature 1..642: note = derived and/or modified sequence opt2 from Namilumab_LightChain1
  source 1..642: mol_type = other RNA
gacatccagatgacccagtccccctcctccgtctccgcctccgtcggcgaccgcgtcaccatcgcctgccgcgcctcccagaacatccgcaacatcctcaactggtaccagcagcgccccggcaaggccccccagctcctcatctacgccgcctccaacctccagtccggcgtcccctcccgcttctccggctccggctccggcaccgacttcaccctcaccatcaactccctccagcccgaggacttcgccacctactactgccagcagtcctactccatgccccgcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15871 - RNA, 1374 nt, synthetic construct
  misc_feature 1..1374: note = derived and/or modified sequence opt2 from Naptumomab_estafenatox_HeavyChain
  source 1..1374: mol_type = other RNA
gaggtccagctccagcagtccggccccgacctcgtcaagcccggcgcctccgtcaagatctcctgcaaggcctccggctactccttcaccggctactacatgcactgggtcaagcagtcccccggcaagggcctcgagtggatcggccgcatcaaccccaacaacggcgtcaccctctacaaccagaagttcaaggacaaggccaccctcaccgtcgacaagtcctccaccaccgcctacatggagctccgctccctcacctccgaggactccgccgtctactactgcgcccgctccaccatgatcaccaactacgtcatggactactggggccagggcacctccgtcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactccggcggcccctccgagaagtccgaggagatcaacgagaaggacctccgcaagaagtccgagctccagggcaccgccctcggcaacctcaagcagatctactactacaactccaaggccatcacctcctccgagaagtccgccgaccagttcctcaccaacaccctcctcttcaagggcttcttcaccggccacccctggtacaacgacctcctcgtcgacctcggctccaccgccgccacctccgagtacgagggctcctccgtcgacctctacggcgcctactacggctaccagtgcgccggcggcacccccaacaagaccgcctgcatgtacggcggcgtcaccctccacgacaacaaccgcctcaccgaggagaagaaggtccccatcaacctctggatcgacggcaagcagaccaccgtccccatcgacaaggtcaagacctccaagaaggaggtcaccgtccaggagctcgacctccaggcccgccactacctccacggcaagttcggcctctacaactccgactccttcggcggcaaggtccagcgcggcctcatcgtcttccactcctccgagggctccaccgtctcctacgacctcttcgacgcccagggccagtaccccgacaccctcctccgcatctaccgcgacaacaccaccatctcctccacctccctctccatctccctctacctctacaccacc

SEQ ID NO: 15872 - RNA, 642 nt, synthetic construct
  misc_feature 1..642: note = derived and/or modified sequence opt2 from Naptumomab_estafenatox_LightChain
  source 1..642: mol_type = other RNA
tccatcgtcatgacccagacccccacctccctcctcgtctccgccggcgaccgcgtcaccatcacctgcaaggcctcccagtccgtctccaacgacgtcgcctggtaccagcagaagcccggccagtcccccaagctcctcatctcctacacctcctcccgctacgccggcgtccccgaccgcttctccggctccggctacggcaccgacttcaccctcaccatctcctccgtccaggccgaggacgccgccgtctacttctgccagcaggactacaactccccccccaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtcc

SEQ ID NO: 15873 - RNA, 1356 nt, synthetic construct
  misc_feature 1..1356: note = derived and/or modified sequence opt2 from Narnatumab_HeavyChain1
  source 1..1356: mol_type = other RNA
gaggtccagctcgtcgagtccggcggcggcctcgtccagcccggcggctccctccgcctctcctgcgccgcctccggcttcaccttctcctcctacctcatgacctgggtccgccaggcccccggcaagggcctcgagtgggtcgccaacatcaagcaggacggctccgagaagtactacgtcgactccgtcaagggccgcttcaccatctcccgcgacaacgccaagaactccctcaacctccagatgaactccctccgcgccgaggacaccgccgtctactactgcacccgcgacggctactcctccggccgccactacggcatggacgtctggggccagggcaccaccgtcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15874 - RNA, 642 nt, synthetic construct
  misc_feature 1..642: note = derived and/or modified sequence opt2 from Narnatumab_LightChain1
  source 1..642: mol_type = other RNA
gagatcgtcctcacccagtcccccgccaccctctccctctcccccggcgagcgcgccaccctctcctgccgcgcctcccagtccgtctcccgctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15875 - RNA, 1350 nt, synthetic construct
  misc_feature 1..1350: note = derived and/or modified sequence opt2 from Natalizumab_HeavyChain1
  source 1..1350: mol_type = other RNA
caggtccagctcgtccagtccggcgccgaggtcaagaagcccggcgcctccgtcaaggtctcctgcaaggcctccggcttcaacatcaaggacacctacatccactgggtccgccaggcccccggccagcgcctcgagtggatgggccgcatcgaccccgccaacggctacaccaagtacgaccccaagttccagggccgcgtcaccatcaccgccgacacctccgcctccaccgcctacatggagctctcctccctccgctccgaggacaccgccgtctactactgcgcccgcgagggctactacggcaactacggcgtctacgccatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15876 - RNA, 639 nt, synthetic construct
  misc_feature 1..639: note = derived and/or modified sequence opt2 from Natalizumab_LightChain1
  source 1..639: mol_type = other RNA
gacatccagatgacccagtccccctcctccctctccgcctccgtcggcgaccgcgtcaccatcacctgcaagacctcccaggacatcaacaagtacatggcctggtaccagcagacccccggcaaggccccccgcctcctcatccactacacctccgccctccagcccggcatcccctcccgcttctccggctccggctccggccgcgactacaccttcaccatctcctccctccagcccgaggacatcgccacctactactgcctccagtacgacaacctctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15877 - RNA, 1335 nt, synthetic construct
  misc_feature 1..1335: note = derived and/or modified sequence opt2 from Navicixizumab_HeavyChain1
  source 1..1335: mol_type = other RNA
caggtccagctcgtccagtccggcgccgaggtcaagaagcccggcgcctccgtcaagatctcctgcaaggcctccggctactccttcaccgcctactacatccactgggtcaagcaggcccccggccagggcctcgagtggatcggctacatctccaactacaaccgcgccaccaactacaaccagaagttcaagggccgcgtcaccttcaccaccgacacctccacctccaccgcctacatggagctccgctccctccgctccgacgacaccgccgtctactactgcgcccgcgactacgactacgacgtcggcatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcgagggcttctacccctccgacatcgccgtcgagtgggagtccaacggccagcccgagaacaactacaagaccaccccccccatgctcgactccgacggctccttcttcctctactccgagctcaccgtcgacaagtcccgctggcagcagggcaacgtcttctcctgctccgtcatgcacgaggccctccacaaccactacacccagaagtccctctccctctcccccggcaag

SEQ ID NO: 15878 - RNA, 1341 nt, synthetic construct
  misc_feature 1..1341: note = derived and/or modified sequence opt2 from Navicixizumab_HeavyChain2
  source 1..1341: mol_type = other RNA
caggtccagctcgtccagtccggcgccgaggtcaagaagcccggcgcctccgtcaaggtctcctgcaaggcctccggctacaccttcaccaactactggatgcactgggtccgccaggcccccggccagggcctcgagtggatgggcgacatcaacccctccaacggccgcacctcctacaaggagaagttcaagcgccgcgtcaccctctccgtcgacaagtcctcctccaccgcctacatggagctctcctccctccgctccgaggacaccgccgtctacttctgcaccatccactacgacgacaagtactaccccctcatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgagaagatgaccaagaaccaggtctccctcacctgcctcgtcaagggcttctacccctccgacatcgccgtcgagtgggagtccaacggccagcccgagaacaactacaagaccaccccccccatgctcaagtccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15879 - RNA, 654 nt, synthetic construct; identical to SEQ ID NO: 15483
  misc_feature 1..654: note = derived and/or modified sequence opt2 from Navicixizumab_LightChain1
  source 1..654: mol_type = other RNA

SEQ ID NO: 15880 - RNA, 1368 nt, synthetic construct
  misc_feature 1..1368: note = derived and/or modified sequence opt2 from Navivumab_HeavyChain1
  source 1..1368: mol_type = other RNA
caggtccagctcgtccagtccggcgccgaggtcaagaagcccggcgcctccgtcaaggtctcctgcaagacctccggctactccttctccacctacggcgtctcctgggtccgccaggcccccggccagggccccgagtgggtcggctggatctccgcctacaccggcatcaccgactacgcccagaagttccagggccgcgtcaccctcaccaccgacgccaccaccgccaccgccttcctcgacctccgctccctccgccccgacgacaccgccacctacttctgcgcccgcgacaaggtccagggccgcgtcgaggtcggctccggcggccgccacgactactggggccagggcaccctcgtcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 15881 - RNA, 645 nt, synthetic construct
  misc_feature 1..645: note = derived and/or modified sequence opt2 from Navivumab_LightChain1
  source 1..645: mol_type = other RNA
gaggtcgtcctcacccagtcccccggcaccctcgccctcccccccggcgagcgcgccaccctctcctgccgcgcctcccaccgcgtcggctccacctacatcgcctggtaccagcagaagtccggccaggccccccgccgcctcatctacggcgcctccaaccgcgccaccgacatccccgaccgcttctccggctccggctccggcaccgacttcaccctcaccatccgccgcctcgagcccgaggactccgccgtctactactgccagcagttctccgtctccccctggaccttcggccagggcacccgcgtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15882 - RNA, 2172 nt, synthetic construct
  misc_feature 1..2172: note = derived and/or modified sequence opt2 from Ndimab-varB_HeavyChain
  source 1..2172: mol_type = other RNA
caggtccagctcgtcgagtccggcggcggcgtcgtccagcccggccgctccctccgcctctcctgcgccgcctccggcttcatcttctcctcctacgccatgcactgggtccgccaggcccccggcaacggcctcgagtgggtcgccttcatgtcctacgacggctccaacaagaagtacgccgactccgtcaagggccgcttcaccatctcccgcgacaactccaagaacaccctctacctccagatgaactccctccgcgccgaggacaccgccgtctactactgcgcccgcgaccgcggcatctccgccggcggcaactactactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagggcggcggcggctccggcggcggcggctcccaggtccagctcgtccagtccggcgccgaggtcaagaagcccggctcctccgtcaaggtctcctgcaaggcctccggcggcaccttctccacctacggcatctcctgggtccgccaggcccccggccagtgcctcgagtggatgggcggcatcatccccatcttcgacaccggcaactccgcccagtccttccagggccgcgtcaccatcaccgccgacgagtccacctccaccgcctacatggagctctcctccctccgctccgaggacaccgccgtctactactgcgcccgctcctcccgcatctacgacctcaacccctccctcaccgcctactacgacatggacgtctggggccagggcaccatggtcaccgtctcctccggcggcggcggctccggcggcggcggctccggcggcggcggctccggcggcggcggctcccagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggactcctccctctccgcctgggtcttcggctgcggcaccaagctcaccgtcctc

SEQ ID NO: 15883 - RNA, 645 nt, synthetic construct
  misc_feature 1..645: note = derived and/or modified sequence opt2 from Ndimab-varB_LightChain
  source 1..645: mol_type = other RNA
gagatcgtcctcacccagtcccccgccaccctctccctctcccccggcgagcgcgccaccctctcctgccgcgcctcccagtccgtctactcctacctcgcctggtaccagcagaagcccggccaggccccccgcctcctcatctacgacgcctccaaccgcgccatcggcatccccgcccgcttctccggctccggctccggcaccgacttcaccctcaccatctcctccctcgagcccgaggacttcgccgtctactactgccagcagcgctccaactggccccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15884 - RNA, 1353 nt, synthetic construct
  misc_feature 1..1353: note = derived and/or modified sequence opt2 from Necitumumab_HeavyChain1
  source 1..1353: mol_type = other RNA
caggtccagctccaggagtccggccccggcctcgtcaagccctcccagaccctctccctcacctgcaccgtctccggcggctccatctcctccggcgactactactggtcctggatccgccagccccccggcaagggcctcgagtggatcggctacatctactactccggctccaccgactacaacccctccctcaagtcccgcgtcaccatgtccgtcgacacctccaagaaccagttctccctcaaggtcaactccgtcaccgccgccgacaccgccgtctactactgcgcccgcgtctccatcttcggcgtcggcaccttcgactactggggccagggcaccctcgtcaccgtctcctccgcctccaccaagggcccctccgtcctccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15885 - RNA, 642 nt, synthetic construct
  misc_feature 1..642: note = derived and/or modified sequence opt2 from Necitumumab_LightChain1
  source 1..642: mol_type = other RNA
gagatcgtcatgacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccaccagtacggctccacccccctcaccttcggcggcggcaccaaggccgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15886 - RNA, 396 nt, synthetic construct
  misc_feature 1..396: note = derived and/or modified sequence opt2 from Neliximab_HeavyChain_VH-Region
  source 1..396: mol_type = other RNA
gaggtccagctccagcagtccggccccgagctcgtcaagcccggcgcctccgtcaagatgtcctgcaaggcctccggctacaccttcaccacctacgtcatgcactgggtcaagcagaagcccggccagggcctcgagtggatcggctacatcaacccctacaacgacggcaccaactacaacgagaagttcaagggcaaggccaccctcacctccgacaagtcctcctccaccgcctacatggagctctccaccctcacctccgaggactccgccgtctactactgcgccgagttcatcaccaagaccgtcggcggctccaactggtacctcgacgtctggggcgccggcaccaccgtcaccgtctcctccgccaagaccaccccccccaagctc

SEQ ID NO: 15887 - RNA, 372 nt, synthetic construct
  misc_feature 1..372: note = derived and/or modified sequence opt2 from Neliximab_HeavyChain_VH-Region_variant1
  source 1..372: mol_type = other RNA
caggtccagctcaagcagtccggccccgagctcgtcaagcccggcgcctccgtcaagatgtcctgcaaggcctccggctacaccttcaccacctacgtcatgcactgggtcaagcagaagcccggccagggcctcgagtggatcggctacatcaacccctacaacgacggcaccaactacaacgagaagttcaagggcaaggccaccctcacctccgacaagtcctcctccaccgcctacatggagctctccaccctcacctccgaggactccgccgtctactactgcgccgagttcatcaccaagaccgtcggcggctccaactggtacctcgacgtctggggcgccggcaccaccgtcaccgtctcctcc

SEQ ID NO: 15888 - RNA, 318 nt, synthetic construct
  misc_feature 1..318: note = derived and/or modified sequence opt2 from Neliximab_LightChain_VL-Region
  source 1..318: mol_type = other RNA
gacatcgtcctcacccagtcccccgccatcatgtccgcctcccccggcgagaaggtcaccatgacctgctccgcctcctcctccatctcctacatccactggttccagcagaagcccggcacctcccccaagcgctggatctacgacacctccaagctcccctccggcgtccccgcccgcttctccggctccggctccggcacctcctactccctcaccatctcctccatggaggccgaggacgccgccacctactactgccaccagcgctcctcctacacctggaccttcggcggcggcaccaagctcgagatcaag

SEQ ID NO: 15889 - RNA, 354 nt, synthetic construct
  misc_feature 1..354: note = derived and/or modified sequence opt2 from Neliximab_LightChain_VL-Region_variant1
  source 1..354: mol_type = other RNA
cagatcgtcctcacccagtcccccgccatcatgtccgcctcccccggcgagaaggtcaccatgacctgctccgcctcctcctccatctcctacatccactggttccagcagaagcccggcacctcccccaagcgctggatctacgacacctccaagctcccctccggcgtccccgcccgcttctccggctccggctccggcacctcctactccctcaccatctcctccatggaggccgaggacgccgccacctactactgccaccagcgctcctcctacacctggaccttcggcggcggcaccaagctcgagatcaagcgcgccgacgccgcccccaccgtctccgccgccgcc

SEQ ID NO: 15890 - RNA, 1335 nt, synthetic construct
  misc_feature 1..1335: note = derived and/or modified sequence opt2 from Nemolizumab_HeavyChain1
  source 1..1335: mol_type = other RNA
caggtccagctcgtccagtccggcgccgaggtcaagaagcccggcgcctccgtcaaggtctcctgcaaggcctccggctacaccttcaccggctacatcatgaactgggtccgccaggcccccggccagggcctcgagtggatgggcctcatcaacccctacaacggcggcaccgactacaacccccagttccaggaccgcgtcaccatcaccgccgacaagtccacctccaccgcctacatggagctctcctccctccgctccgaggacaccgccgtctactactgcgcccgcgacggctacgacgacggcccctacaccctcgagacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtcctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcaggagggcaacgtcttctcctgctccgtcatgcacgaggccctccacaaccactacacccagaagtccctctccctctccccc

SEQ ID NO: 15891 - RNA, 642 nt, synthetic construct
  misc_feature 1..642: note = derived and/or modified sequence opt2 from Nemolizumab_LightChain1
  source 1..642: mol_type = other RNA
gacatccagatgacccagtccccctcctccctctccgcctccgtcggcgaccgcgtcaccatcacctgccaggcctccgaggacatctactccttcgtcgcctggtaccagcagaagcccggcaaggcccccaagctcctcatctacaacgcccagaccgaggcccagggcgtcccctcccgcttctccggctccggctccggcaccgacttcaccctcaccatctcctccctccagcccgaggacttcgccacctactactgccagcaccactacgactcccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15892 - RNA, 1356 nt, synthetic construct
  misc_feature 1..1356: note = derived and/or modified sequence opt2 from Nesvacumab_HeavyChain1
  source 1..1356: mol_type = other RNA
gaggtccagctcgtcgagtccggcggcggcctcgtccagcccggcggctccctccgcctctcctgcgccgcctccggcttcaccttctcctcctacgacatccactgggtccgccaggccaccggcaagggcctcgagtgggtctccgccatcggccccgccggcgacacctactaccccggctccgtcaagggccgcttcaccatctcccgcgagaacgccaagaactccctctacctccagatgaactccctccgcgccggcgacaccgccgtctactactgcgcccgcggcctcatcaccttcggcggcctcatcgcccccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15893 - RNA, 642 nt, synthetic construct
  misc_feature 1..642: note = derived and/or modified sequence opt2 from Nesvacumab_LightChain1
  source 1..642: mol_type = other RNA
gagatcgtcctcacccagtcccccggcaccctctccctctcccccggcgagcgcgccaccctctcctgccgcgcctcccagtccgtctcctccacctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcactacgacaactcccagaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15894 - RNA, 1362 nt, synthetic construct
  misc_feature 1..1362: note = derived and/or modified sequence opt2 from Neuradiab_HeavyChain1
  source 1..1362: mol_type = other RNA
gaggtccagctccagcagtccggccccgagctcgtcaagcccggcgcctccgtcaagatgtcctgcaaggcctccggctacaccttcacctcctacgtcgtccactgggtcaagcagaaccccggccagggcctcgagtggatcggctacatcaaccccttcaacgacggcaccaagtacaacgagaacttcaagtgcaaggccaccctcacctccgaccgctcctcctccaccgcctacatggagctctcctccctcacctccgaggagtccgccgtctacttctgcgcccgcgacatgggccgcgagggcttcgcctactggggccagggcaccctcgtcaccgtctccgccgccaagaccacccccccctccgtctaccccctcgcccccggctgcggcgacaccaccggctcctccgtcaccctcggctgcctcgtcaagggctacttccccgagtccgtcaccgtcacctggaactccggctccctctcctcctccgtccacaccttccccgccctcctccagtccggcctctacaccatgtcctcctccgtcaccgtcccctcctccacctggccctcccagatcgtcatctgctccgtcgcccaccccgcctcctccaccaccgtcgacaagaagctcgagccctccggccccatctccaccatcaacccctgccccccctgcaaggagtgccacaagtgccccgcccccaacctcgagggcggcccctccgtcttcatcttcccccccaacatcaaggacgtcctcatgatctccctcacccccaaggtcacctgcgtcgtcgtcgacgtctccgaggacgaccccgacgtccagatctcctggttcgtcaacaacgtcgaggtccacaccgcccagacccagacccaccgcgaggactacaactccaccatccgcgtcgtctccaccctccccatccagcaccaggactggatgtccggcaaggagttcaagtgcaaggtcaacaacaaggacctcccctcccccatcgagcgcaccatctccaagatcaagggcctcgtccgcgccccccaggtctacatcctccccccccccgccgagcagctctcccgcaaggacgtctccctcacctgcctcgtcgtcggcttcaaccccggcgacatctccgtcgagtggacctccaacggccacaccgaggagaactacaaggacaccgcccccgtcctcgactccgacggctcctacttcatctactccaagctcaacatgaagacctccaagtgggagaagaccgactccttctcctgcaacgtccgccacgagggcctcaagaactactacctcaagaagaccatctcccgctcccccggcaag

SEQ ID NO: 15895 - RNA, 657 nt, synthetic construct
  misc_feature 1..657: note = derived and/or modified sequence opt2 from Neuradiab_LightChain1
  source 1..657: mol_type = other RNA
gacatcgtcatgacccaggccgccttctccaaccccgtcaccctcggcacctccgcctccatctcctgccgctcctccaagtccctcctccactccaacggcatcacctacctctactggtacctccagaagcccggccagtccccccagctcctcatctaccagatgtccaacctcgcctccggcgtccccgaccgcttctcctcctccggctccggcaccgacttcaccctccgcatctcccgcgtcgaggccgaggacgtcggcgtctactactgcgcccagaacctcgagctcccccgcaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 15896 - RNA, 369 nt, synthetic construct
  misc_feature 1..369: note = derived and/or modified sequence opt2 from Nimotuzumab_HeavyChain1
  source 1..369: mol_type = other RNA
caggtccagctccagcagtccggcgccgaggtcaagaagcccggctcctccgtcaaggtctcctgcaaggcctccggctacaccttcaccaactactacatctactgggtccgccaggcccccggccagggcctcgagtggatcggcggcatcaaccccacctccggcggctccaacttcaacgagaagttcaagacccgcgtcaccatcaccgtcgacgagtccaccaacaccgcctacatggagctctcctccctccgctccgaggacaccgccttctacttctgcgcccgccagggcctctggttcgactccgacggccgcggcttcgacttctggggccagggctccaccgtcaccgtctcctcc

SEQ ID NO: 15897 - RNA, 342 nt, synthetic construct
  misc_feature 1..342: note = derived and/or modified sequence opt2 from Nimotuzumab_LightChain1
  source 1..342: mol_type = other RNA
gacatccagatgacccagtccccctcctccctctccgcctccgtcggcgaccgcgtcaccatcacctgccgctcctcccagaacatcgtccactccaacggcaacacctacctcgactggtaccagcagacccccggcaaggcccccaagctcctcatctacaaggtctccaaccgcttctccggcgtcccctcccgcttctccggctccggctccggcaccgacttcaccttcaccatctcctccctccagcccgaggacatcgccacctactactgcttccagtactcccacgtcccctggaccttcggccagggcaccaagctccagatcacccgcgag

SEQ ID NO: 15898 - RNA, 1320 nt, synthetic construct
  misc_feature 1..1320: note = derived and/or modified sequence opt2 from Nivolumab_HeavyChain1
  source 1..1320: mol_type = other RNA
caggtccagctcgtcgagtccggcggcggcgtcgtccagcccggccgctccctccgcctcgactgcaaggcctccggcatcaccttctccaactccggcatgcactgggtccgccaggcccccggcaagggcctcgagtgggtcgccgtcatctggtacgacggctccaagcgctactacgccgactccgtcaagggccgcttcaccatctcccgcgacaactccaagaacaccctcttcctccagatgaactccctccgcgccgaggacaccgccgtctactactgcgccaccaacgacgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15899 - RNA, 642 nt, synthetic construct
  misc_feature 1..642: note = derived and/or modified sequence opt2 from Nivolumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagtcctccaactggccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15900 - RNA, 1347 nt, synthetic construct
  misc_feature 1..1347: note = derived and/or modified sequence opt2 from Obiltoxaximab_HeavyChain1
  source 1..1347: mol_type = other RNA
caggtccagctccagcagtccggccccgagctcaagaagcccggcgcctccgtcaaggtctcctgcaaggactccggctacgccttctcctcctcctggatgaactgggtccgccaggcccccggccagggcctcgagtggatcggccgcatctaccccggcgacggcgacaccaactacaacggcaagttccagggccgcgtcaccatcaccgccgacaagtcctcctccaccgcctacatggagctctcctccctccgctccgaggacaccgccgtctacttctgcgcccgctccggcctcctccgctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15901 - RNA, 642 nt, synthetic construct
  misc_feature 1..642: note = derived and/or modified sequence opt2 from Obiltoxaximab_LightChain1
  source 1..642: mol_type = other RNA
gacatccagatgacccagtccccctcctccctctccgcctccgtcggcgaccgcgtcaccatcacctgccgcgcctcccaggacatccgcaactacctcaactggtaccagcagaagcccggcaaggccgtcaagctcctcatctactacacctcccgcctcctccccggcgtcccctcccgcttctccggctccggctccggcaccgactactccctcaccatctcctcccaggagcaggaggacatcggcacctacttctgccagcagggcaacaccctcccctggaccttcggccagggcaccaaggtcgagatccgccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15902 - RNA, 1347 nt, synthetic construct; identical to SEQ ID NO: 15306
  misc_feature 1..1347: note = derived and/or modified sequence opt2 from Obinutuzumab_HeavyChain1
  source 1..1347: mol_type = other RNA

SEQ ID NO: 15903 - RNA, 657 nt, synthetic construct; identical to SEQ ID NO: 15307
  misc_feature 1..657: note = derived and/or modified sequence opt2 from Obinutuzumab_LightChain1
  source 1..657: mol_type = other RNA

SEQ ID NO: 15904 - RNA, 1350 nt, synthetic construct
  misc_feature 1..1350: note = derived and/or modified sequence opt2 from Ocaratuzumab_HeavyChain1
  source 1..1350: mol_type = other RNA
gaggtccagctcgtccagtccggcgccgaggtcaagaagcccggcgagtccctcaagatctcctgcaagggctccggccgcaccttcacctcctacaacatgcactgggtccgccagatgcccggcaagggcctcgagtggatgggcgccatctaccccctcaccggcgacacctcctacaaccagaagtccaagctccaggtcaccatctccgccgacaagtccatctccaccgcctacctccagtggtcctccctcaaggcctccgacaccgccatgtactactgcgcccgctccacctacgtcggcggcgactggcagttcgacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagatcaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaagcagaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15905 - RNA, 639 nt, synthetic construct
  misc_feature 1..639: note = derived and/or modified sequence opt2 from Ocaratuzumab_LightChain1
  source 1..639: mol_type = other RNA
gagatcgtcctcacccagtcccccggcaccctctccctctcccccggcgagcgcgccaccctctcctgccgcgcctcctcctccgtcccctacatccactggtaccagcagaagcccggccaggccccccgcctcctcatctacgccacctccgccctcgcctccggcatccccgaccgcttctccggctccggctccggcaccgacttcaccctcaccatctcccgcctcgagcccgaggacttcgccgtctactactgccagcagtggctctccaacccccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15906 - RNA, 1356 nt, synthetic construct
  misc_feature 1..1356: note = derived and/or modified sequence opt2 from Ocrelizumab_HeavyChain1
  source 1..1356: mol_type = other RNA
gaggtccagctcgtcgagtccggcggcggcctcgtccagcccggcggctccctccgcctctcctgcgccgcctccggctacaccttcacctcctacaacatgcactgggtccgccaggcccccggcaagggcctcgagtgggtcggcgccatctaccccggcaacggcgacacctcctacaaccagaagttcaagggccgcttcaccatctccgtcgacaagtccaagaacaccctctacctccagatgaactccctccgcgccgaggacaccgccgtctactactgcgcccgcgtcgtctactactccaactcctactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15907 - RNA, 639 nt, synthetic construct
  misc_feature 1..639: note = derived and/or modified sequence opt2 from Ocrelizumab_LightChain1
  source 1..639: mol_type = other RNA
gacatccagatgacccagtccccctcctccctctccgcctccgtcggcgaccgcgtcaccatcacctgccgcgcctcctcctccgtctcctacatgcactggtaccagcagaagcccggcaaggcccccaagcccctcatctacgccccctccaacctcgcctccggcgtcccctcccgcttctccggctccggctccggcaccgacttcaccctcaccatctcctccctccagcccgaggacttcgccacctactactgccagcagtggtccttcaacccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15908 - RNA, 1356 nt, synthetic construct
  misc_feature 1..1356: note = derived and/or modified sequence opt2 from Ofatumumab_HeavyChain1
  source 1..1356: mol_type = other RNA
gaggtccagctcgtcgagtccggcggcggcctcgtccagcccggccgctccctccgcctctcctgcgccgcctccggcttcaccttcaacgactacgccatgcactgggtccgccaggcccccggcaagggcctcgagtgggtctccaccatctcctggaactccggctccatcggctacgccgactccgtcaagggccgcttcaccatctcccgcgacaacgccaagaagtccctctacctccagatgaactccctccgcgccgaggacaccgccctctactactgcgccaaggacatccagtacggcaactactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15909 - RNA, 642 nt, synthetic construct
  misc_feature 1..642: note = derived and/or modified sequence opt2 from Ofatumumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccatcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15910 - RNA, 1371 nt, synthetic construct
  misc_feature 1..1371: note = derived and/or modified sequence opt2 from Olaratumab_HeavyChain1
  source 1..1371: mol_type = other RNA
cagctccagctccaggagtccggccccggcctcgtcaagccctccgagaccctctccctcacctgcaccgtctccggcggctccatcaactcctcctcctactactggggctggctccgccagtcccccggcaagggcctcgagtggatcggctccttcttctacaccggctccacctactacaacccctccctccgctcccgcctcaccatctccgtcgacacctccaagaaccagttctccctcatgctctcctccgtcaccgccgccgacaccgccgtctactactgcgcccgccagtccacctactactacggctccggcaactactacggctggttcgaccgctgggaccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15911 - RNA, 642 nt, synthetic construct
  misc_feature 1..642: note = derived and/or modified sequence opt2 from Olaratumab_LightChain1
  source 1..642: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccgccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15912 - RNA, 1341 nt, synthetic construct
  misc_feature 1..1341: note = derived and/or modified sequence opt2 from Olizuab_HeavyChain1
  source 1..1341: mol_type = other RNA
gaggtccagctcgtcgagtccggcggcggcctcgtccagcccggcggctccctccgcctctcctgcgccgtctccggctactccatcacctccggctactcctggaactggatccgccaggcccccggcaagggcctcgagtgggtcgcctccatcacctacgacggctccaccaactacaacccctccgtcaagggccgcatcaccatctcccgcgacgactccaagaacaccttctacctccagaactccctccgcgccgaggacaccgccgtctactactgcgcccgcggctcccactacttcggccactggcacttcgccgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 15913 - RNA, 651 nt, synthetic construct
  misc_feature 1..651: note = derived and/or modified sequence opt2 from Olizuab_LightChain1
  source 1..651: mol_type = other RNA
gacatccagctcacccagtccccctcctccctctccgcctccgtcggcgaccgcgtcaccatcacctgccgcgcctcccagtccgtcgactacgacggcgactcctacaactggtaccagcagaagcccggcaaggcccccaagctcctcatctacgccgcctcctacctcgagtccggcgtcccctcccgcttctccggctccggctccggcaccgacttcaccctcaccatctcctccctccagcccgaggacttcgccacctactactgccagcagtcccacgaggacccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15914 - RNA, 1341 nt, synthetic construct
  misc_feature 1..1341: note = derived and/or modified sequence opt2 from Olokizumab_HeavyChain1
  source 1..1341: mol_type = other RNA
gaggtccagctcgtcgagtccggcggcggcctcgtccagcccggcggctccctccgcctctcctgcgccgcctccggcttcaacttcaacgactacttcatgaactgggtccgccaggcccccggcaagggcctcgagtgggtcgcccagatgcgcaacaagaactaccagtacggcacctactacgccgagtccctcgagggccgcttcaccatctcccgcgacgactccaagaactccctctacctccagatgaactccctcaagaccgaggacaccgccgtctactactgcgcccgcgagtcctactacggcttcacctcctactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 15915 - RNA, 642 nt, synthetic construct
  misc_feature 1..642: note = derived and/or modified sequence opt2 from Olokizumab_LightChain1
  source 1..642: mol_type = other RNA
gacatccagatgacccagtccccctcctccctctccgcctccgtcggcgaccgcgtcaccatcacctgccaggcctcccaggacatcggcatctccctctcctggtaccagcagaagcccggcaaggcccccaagctcctcatctacaacgccaacaacctcgccgacggcgtcccctcccgcttctccggctccggctccggcaccgacttcaccctcaccatctcctccctccagcccgaggacttcgccacctactactgcctccagcacaactccgccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15916 - RNA, 1341 nt, synthetic construct
  misc_feature 1..1341: note = derived and/or modified sequence opt2 from Omalizumab_HeavyChain
  source 1..1341: mol_type = other RNA
gaggtccagctcgtcgagtccggcggcggcctcgtccagcccggcggctccctccgcctctcctgcgccgtctccggctactccatcacctccggctactcctggaactggatccgccaggcccccggcaagggcctcgagtgggtcgcctccatcacctacgacggctccaccaactacgccgactccgtcaagggccgcttcaccatctcccgcgacgactccaagaacaccttctacctccagatgaactccctccgcgccgaggacaccgccgtctactactgcgcccgcggctcccactacttcggccactggcacttcgccgtctggggccagggcaccctcgtcaccgtctcctccggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15917 - RNA, 645 nt, synthetic construct
  misc_feature 1..645: note = derived and/or modified sequence opt2 from Omalizumab_LightChain
  source 1..645: mol_type = other RNA
gacatccagctcacccagtccccctcctccctctccgcctccgtcggcgaccgcgtcaccatcacctgccgcgcctcccagtccgtcgactacgacggcgactcctacatgaactggtaccagcagaagcccggcaaggcccccaagctcctcatctacgccgcctcctacctcgagtccggcgtcccctcccgcttctccggctccggctccggcaccgacttcaccctcaccatctcctccctccagcccgaggacttcgccacctactactgccagcagtcccacgaggacccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 15918 - RNA, 1347 nt, synthetic construct
  misc_feature 1..1347: note = derived and/or modified sequence opt2 from Onartuzumab_HeavyChain1
  source 1..1347: mol_type = other RNA
gaggtccagctcgtcgagtccggcggcggcctcgtccagcccggcggctccctccgcctctcctgcgccgcctccggctacaccttcacctcctactggctccactgggtccgccaggcccccggcaagggcctcgagtgggtcggcatgatcgacccctccaactccgacacccgcttcaaccccaacttcaaggaccgcttcaccatctccgccgacacctccaagaacaccgcctacctccagatgaactccctccgcgccgaggacaccgccgtctactactgcgccacctaccgctcctacgtcacccccctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctctcctgcgccgtcaagggcttctacccctccgacatcgccgtcgagtgggagtccaacggccagcccgagaacaactacaagaccaccccccccgtcctcgactccgacggctccttcttcctcgtctccaagctcaccgtcgacaagtcccgctggcagcagggcaacgtcttctcctgctccgtcatgcacgaggccctccacaaccactacacccagaagtccctctccctctcccccggcaag

SEQ ID NO: 15919 - RNA, 681 nt, synthetic construct
  misc_feature 1..681: note = derived and/or modified sequence opt2 from Onartuzumab_HeavyChain2
  source 1..681: mol_type = other RNA
gacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctctggtgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15920 - RNA, 660 nt, synthetic construct
  misc_feature 1..660: note = derived and/or modified sequence opt2 from Onartuzumab_LightChain1
  source 1..660: mol_type = other RNA
gacatccagatgacccagtccccctcctccctctccgcctccgtcggcgaccgcgtcaccatcacctgcaagtcctcccagtccctcctctacacctcctcccagaagaactacctcgcctggtaccagcagaagcccggcaaggcccccaagctcctcatctactgggcctccacccgcgagtccggcgtcccctcccgcttctccggctccggctccggcaccgacttcaccctcaccatctcctccctccagcccgaggacttcgccacctactactgccagcagtactacgcctacccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15921 - RNA, 1362 nt, synthetic construct
  misc_feature 1..1362: note = derived and/or modified sequence opt2 from Ontuxizumab_HeavyChain1
  source 1..1362: mol_type = other RNA
caggtccagctccaggagtccggccccggcctcgtccgcccctcccagaccctctccctcacctgcaccgcctccggctacaccttcaccgactacgtcatccactgggtcaagcagccccccggccgcggcctcgagtggatcggctacatcaacccctacgacgacgacaccacctacaaccagaagttcaagggccgcgtcaccatgctcgtcgacacctcctccaacaccgcctacctccgcctctcctccgtcaccgccgaggacaccgccgtctactactgcgcccgccgcggcaactcctacgacggctacttcgactactccatggactactggggctccggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggcttcttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15922 - RNA, 645 nt, synthetic construct
  misc_feature 1..645: note = derived and/or modified sequence opt2 from Ontuxizumab_LightChain1
  source 1..645: mol_type = other RNA
gacatccagatgacccagtccccctcctccctctccgcctccgtcggcgaccgcgtcaccatcacctgccgcgcctcccagaacgtcggcaccgccgtcgcctggctccagcagacccccggcaaggcccccaagctcctcatctactccgcctccaaccgctacaccggcgtcccctcccgcttctccggctccggctccggcaccgactacaccttcaccatctcctccctccagcccgaggacatcgccacctactactgccagcagtacaccaactaccccatgtacaccttcggccagggcaccaaggtccagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15923 - RNA, 1341 nt, synthetic construct
  misc_feature 1..1341: note = derived and/or modified sequence opt2 from Opicinumab_HeavyChain1
  source 1..1341: mol_type = other RNA
gaggtccagctcctcgagtccggcggcggcctcgtccagcccggcggctccctccgcctctcctgcgccgcctccggcttcaccttctccgcctacgagatgaagtgggtccgccaggcccccggcaagggcctcgagtgggtctccgtcatcggcccctccggcggcttcaccttctacgccgactccgtcaagggccgcttcaccatctcccgcgacaactccaagaacaccctctacctccagatgaactccctccgcgccgaggacaccgccgtctactactgcgccaccgagggcgacaacgacgccttcgacatctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccgcctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15924 - RNA, 645 nt, synthetic construct
  misc_feature 1..645: note = derived and/or modified sequence opt2 from Opicinumab_LightChain1
  source 1..645: mol_type = other RNA
gacatccagatgacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccatgtacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15925 - RNA, 1941 nt, synthetic construct
  misc_feature 1..1941: note = derived and/or modified sequence opt2 from Oportuzumab_monatox_HeavyChain1
  source 1..1941: mol_type = other RNA
caccaccaccaccaccacgacatccagatgacccagtccccctcctccctctccgcctccgtcggcgaccgcgtcaccatcacctgccgctccaccaagtccctcctccactccaacggcatcacctacctctactggtaccagcagaagcccggcaaggcccccaagctcctcatctaccagatgtccaacctcgcctccggcgtcccctcccgcttctcctcctccggctccggcaccgacttcaccctcaccatctcctccctccagcccgaggacttcgccacctactactgcgcccagaacctcgagatcccccgcaccttcggccagggcaccaaggtcgagctcaagcgcgccaccccctcccacaactcccaccaggtcccctccgccggcggccccaccgccaactccggcacctccggctccgaggtccagctcgtccagtccggccccggcctcgtccagcccggcggctccgtccgcatctcctgcgccgcctccggctacaccttcaccaactacggcatgaactgggtcaagcaggcccccggcaagggcctcgagtggatgggctggatcaacacctacaccggcgagtccacctacgccgactccttcaagggccgcttcaccttctccctcgacacctccgcctccgccgcctacctccagatcaactccctccgcgccgaggacaccgccgtctactactgcgcccgcttcgccatcaagggcgactactggggccagggcaccctcctcaccgtctcctccgagttcggcggcgcccccgagttccccaagccctccaccccccccggctcctccggcctcgagggcggctccctcgccgccctcaccgcccaccaggcctgccacctccccctcgagaccttcacccgccaccgccagccccgcggctgggagcagctcgagcagtgcggctaccccgtccagcgcctcgtcgccctctacctcgccgcccgcctctcctggaaccaggtcgaccaggtcatccgcaacgccctcgcctcccccggctccggcggcgacctcggcgaggccatccgcgagcagcccgagcaggcccgcctcgccctcaccctcgccgccgccgagtccgagcgcttcgtccgccagggcaccggcaacgacgaggccggcgccgcctccgccgacgtcgtctccctcacctgccccgtcgccgccggcgagtgcgccggccccgccgactccggcgacgccctcctcgagcgcaactaccccaccggcgccgagttcctcggcgacggcggcgacgtctccttctccacccgcggcacccagaactggaccgtcgagcgcctcctccaggcccaccgccagctcgaggagcgcggctacgtcttcgtcggctaccacggcaccttcctcgaggccgcccagtccatcgtcttcggcggcgtccgcgcccgctcccaggacctcgacgccatctggcgcggcttctacatcgccggcgaccccgccctcgcctacggctacgcccaggaccaggagcccgacgcccgcggccgcatccgcaacggcgccctcctccgcgtctacgtcccccgctcctccctccccggcttctaccgcaccggcctcaccctcgccgcccccgaggccgccggcgaggtcgagcgcctcatcggccaccccctccccctccgcctcgacgccatcaccggccccgaggaggagggcggccgcctcgagaccatcctcggctggcccctcgccgagcgcaccgtcgtcatcccctccgccatccccaccgacccccgcaacgtcggcggcgacctcgacccctcctccatccccgacaaggagcaggccatctccgccctccccgactacgcctcccagcccggcaagcccccccaccaccaccaccaccacaaggacgagctc

SEQ ID NO: 15926 - RNA, 1941 nt, synthetic construct; identical to SEQ ID NO: 15925
  misc_feature 1..1941: note = derived and/or modified sequence opt2 from Oportuzumab_monatox_SingleChain_variable_fragment
  source 1..1941: mol_type = other RNA

SEQ ID NO: 15927 - RNA, 762 nt, synthetic construct
  misc_feature 1..762: note = derived and/or modified sequence opt2 from Oreptacog_alfa_HeavyChain1
  source 1..762: mol_type = other RNA
atcgtcggcggcaaggtctgccccaagggcgagtgcccctggcaggtcctcctcctcgtcaacggcgcccagctctgcggcggcaccctcatcaacaccatctgggtcgtctccgccgcccactgcttcgacaagatcaagaactggcgcaacctcatcgccgtcctcggcgagcacgacctctccgagcacgacggcgacgagcagtcccgccgcgtcgcccaggtcatcatcccctccacctacgtccccggcaccaccaaccacgacatcgccctcctccgcctccaccagcccgtcaacctcaccgaccacgtcgtccccctctgcctccccgagcgcaccttctccgagcgcaccctcgccttcgtccgcttctccctcgtctccggctggggccagctcctcgaccgcggcgccaccgccctcgagctcatggtcctcaacgtcccccgcctcatgacccaggactgcctccagcagtcccgcaaggtcggcgactcccccaacatcaccgagtacatgttctgcgccggctactccgacggctccaaggactcctgcaagggcgactccggcggcccccacgccacccactaccgcggcacctggtacctcaccggcatcgtctcctggggccagggctgcgccaccgtcggccacttcggcgtctacacccgcgtctcccagtacatcgagtggctccagaagctcatgcgctccgagccccgccccggcgtcctcctccgcgcccccttcccc

SEQ ID NO: 15928 - RNA, 456 nt, synthetic construct
  misc_feature 1..456: note = derived and/or modified sequence opt2 from Oreptacog_alfa_LightChain1
  source 1..456: mol_type = other RNA
gccaacgccttcctcgaggagctccgccagggctccctcgagcgcgagtgcaaggaggagcagtgctccttcgaggaggcccgcgagatcttcgaggacgaggaggagaccaagctcttctggatctcctactccgacggcgaccagtgcgcctcctccccctgccagaacggcggctcctgcaaggaccagctccagtcctacatctgcttctgcctccccgccttcgagggccgcaactgcgagacccacaaggacgaccagctcatctgcgtcaacgagaacggcggctgcgagcagtactgctccgaccacaacggcaccaagcgctcctgccgctgccacgagggctactccctcctcgccgacggcgtctcctgcacccccaccgtcgagtacccctgcggcaagatccccatcctcgagaagcgcaacgcctccaagccccagggccgc

SEQ ID NO: 15929 - RNA, 1353 nt, synthetic construct
  misc_feature 1..1353: note = derived and/or modified sequence opt2 from Orticumab_HeavyChain1
  source 1..1353: mol_type = other RNA
gaggtccagctcctcgagtccggcggcggcctcgtccagcccggcggctccctccgcctctcctgcgccgcctccggcttcaccttctccaacgcctggatgtcctgggtccgccaggcccccggcaagggcctcgagtgggtctcctccatctccgtcggcggccaccgcacctactacgccgactccgtcaagggccgctccaccatctcccgcgacaactccaagaacaccctctacctccagatgaactccctccgcgccgaggacaccgccgtctactactgcgcccgcatccgcgtcggcccctccggcggcgccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15930 - RNA, 648 nt, synthetic construct
  misc_feature 1..648: note = derived and/or modified sequence opt2 from Orticumab_LightChain1
  source 1..648: mol_type = other RNA
cagtccgtcctcacccagcccccctccgcctccggcacccccggccagcgcgtcaccatctcctgctccggctccaacaccaacatcggcaagaactacgtctcctggtaccagcagctccccggcaccgcccccaagctcctcatctacgccaactccaaccgcccctccggcgtccccgaccgcttctccggctccaagtccggcacctccgcctccctcgccatctccggcctccgctccgaggacgaggccgactactactgcgcctcctgggacgcctccctcaacggctgggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15931 - RNA, 1347 nt, synthetic construct
  misc_feature 1..1347: note = derived and/or modified sequence opt2 from Otelixizumab_HeavyChain1
  source 1..1347: mol_type = other RNA
gaggtccagctcctcgagtccggcggcggcctcgtccagcccggcggctccctccgcctctcctgcgccgcctccggcttcaccttctcctccttccccatggcctgggtccgccaggcccccggcaagggcctcgagtgggtctccaccatctccacctccggcggccgcacctactaccgcgactccgtcaagggccgcttcaccatctcccgcgacaactccaagaacaccctctacctccagatgaactccctccgcgccgaggacaccgccgtctactactgcgccaagttccgccagtactccggcggcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15932 - RNA, 648 nt, synthetic construct
  misc_feature 1..648: note = derived and/or modified sequence opt2 from Otelixizumab_LightChain1
  source 1..648: mol_type = other RNA
gacatccagctcacccagcccaactccgtctccacctccctcggctccaccgtcaagctctcctgcaccctctcctccggcaacatcgagaacaactacgtccactggtaccagctctacgagggccgctcccccaccaccatgatctacgacgacgacaagcgccccgacggcgtccccgaccgcttctccggctccatcgaccgctcctccaactccgccttcctcaccatccacaacgtcgccatcgaggacgaggccatctacttctgccactcctacgtctcctccttcaacgtcttcggcggcggcaccaagctcaccgtcctccgccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15933 - RNA, 1449 nt, synthetic construct
  misc_feature 1..1449: note = derived and/or modified sequence opt2 from Otlertuzumab_HeavyChain1
  source 1..1449: mol_type = other RNA
gaggtccagctcgtccagtccggcgccgaggtcaagaagcccggcgagtccctcaagatctcctgcaagggctccggctactccttcaccggctacaacatgaactgggtccgccagatgcccggcaagggcctcgagtggatgggcaacatcgacccctactacggcggcaccacctacaaccgcaagttcaagggccaggtcaccatctccgccgacaagtccatctccaccgcctacctccagtggtcctccctcaaggcctccgacaccgccatgtactactgcgcccgctccgtcggccccttcgactcctggggccagggcaccctcgtcaccgtctcctccggcggcggcggctccggcggcggcggctccggcggcggcggctccggcggcggcggctccggcggcggcggctccgagatcgtcctcacccagtcccccgccaccctctccctctcccccggcgagcgcgccaccctctcctgccgcgcctccgagaacgtctactcctacctcgcctggtaccagcagaagcccggccaggccccccgcctcctcatctacttcgccaagaccctcgccgagggcatccccgcccgcttctccggctccggctccggcaccgacttcaccctcaccatctcctccctcgagcccgaggacttcgccgtctactactgccagcaccactccgacaacccctggaccttcggccagggcaccaaggtcgagatcaagggcgaccaggagcccaagtcctccgacaagacccacacctcccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15934 - RNA, 1347 nt, synthetic construct
  misc_feature 1..1347: note = derived and/or modified sequence opt2 from Oxelumab_HeavyChain1
  source 1..1347: mol_type = other RNA
gaggtccagctcctcgagtccggcggcggcctcgtccagcccggcggctccctccgcctctcctgcgccgcctccggcttcaccttcaactcctacgccatgtcctgggtccgccaggcccccggcaagggcctcgagtgggtctccatcatctccggctccggcggcttcacctactacgccgactccgtcaagggccgcttcaccatctcccgcgacaactcccgcaccaccctctacctccagatgaactccctccgcgccgaggacaccgccgtctactactgcgccaaggaccgcctcgtcgcccccggcaccttcgactactggggccagggcgccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15935 - RNA, 642 nt, synthetic construct
  misc_feature 1..642: note = derived and/or modified sequence opt2 from Oxelumab_LightChain1
  source 1..642: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15936 - RNA, 1329 nt, synthetic construct
  misc_feature 1..1329: note = derived and/or modified sequence opt2 from Ozanezumab_HeavyChain1
  source 1..1329: mol_type = other RNA
caggtccagctcgtccagtccggcgccgaggtcaagaagcccggcgcctccgtcaaggtctcctgcaaggcctccggctacaccttcacctcctactggatgcactgggtccgccaggcccccggccagggcctcgagtggatcggcaacatcaacccctccaacggcggcaccaactacaacgagaagttcaagtccaaggccaccatgacccgcgacacctccacctccaccgcctacatggagctctcctccctccgctccgaggacaccgccgtctactactgcgagctcatgcagggctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15937 - RNA, 657 nt, synthetic construct
  misc_feature 1..657: note = derived and/or modified sequence opt2 from Ozanezumab_LightChain1
  source 1..657: mol_type = other RNA
gacatcgtcatgacccagtcccccctctccaaccccgtcaccctcggccagcccgtctccatctcctgccgctcctccaagtccctcctctacaaggacggcaagacctacctcaactggttcctccagcgccccggccagtccccccagctcctcatctacctcatgtccacccgcgcctccggcgtccccgaccgcttctccggcggcggctccggcaccgacttcaccctcaagatctcccgcgtcgaggccgaggacgtcggcgtctactactgccagcagctcgtcgagtaccccctcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15938 - RNA, 1089 nt, synthetic construct
  misc_feature 1..1089: note = derived and/or modified sequence opt2 from Ozoralizumab_HeavyChain1
  source 1..1089: mol_type = other RNA
gaggtccagctcgtcgagtccggcggcggcctcgtccagcccggcggctccctccgcctctcctgcgccgcctccggcttcaccttctccgactactggatgtactgggtccgccaggcccccggcaagggcctcgagtgggtctccgagatcaacaccaacggcctcatcaccaagtaccccgactccgtcaagggccgcttcaccatctcccgcgacaacgccaagaacaccctctacctccagatgaactccctccgccccgaggacaccgccgtctactactgcgcccgctccccctccggcttcaaccgcggccagggcaccctcgtcaccgtctcctccggcggcggcggctccggcggcggctccgaggtccagctcgtcgagtccggcggcggcctcgtccagcccggcaactccctccgcctctcctgcgccgcctccggcttcaccttctcctccttcggcatgtcctgggtccgccaggcccccggcaagggcctcgagtgggtctcctccatctccggctccggctccgacaccctctacgccgactccgtcaagggccgcttcaccatctcccgcgacaacgccaagaccaccctctacctccagatgaactccctccgccccgaggacaccgccgtctactactgcaccatcggcggctccctctcccgctcctcccagggcaccctcgtcaccgtctcctccggcggcggcggctccggcggcggctccgaggtccagctcgtcgagtccggcggcggcctcgtccagcccggcggctccctccgcctctcctgcgccgcctccggcttcaccttctccgactactggatgtactgggtccgccaggcccccggcaagggcctcgagtgggtctccgagatcaacaccaacggcctcatcaccaagtaccccgactccgtcaagggccgcttcaccatctcccgcgacaacgccaagaacaccctctacctccagatgaactccctccgccccgaggacaccgccgtctactactgcgcccgctccccctccggcttcaaccgcggccagggcaccctcgtcaccgtctcctcc

SEQ ID NO: 15939 - RNA, 1350 nt, synthetic construct
  misc_feature 1..1350: note = derived and/or modified sequence opt2 from Palivizumab_HeavyChain
  source 1..1350: mol_type = other RNA
caggtcaccctccgcgagtccggccccgccctcgtcaagcccacccagaccctcaccctcacctgcaccttctccggcttctccctctccacctccggcatgtccgtcggctggatccgccagccccccggcaaggccctcgagtggctcgccgacatctggtgggacgacaagaaggactacaacccctccctcaagtcccgcctcaccatctccaaggacacctccaagaaccaggtcgtcctcaaggtcaccaacatggaccccgccgacaccgccacctactactgcgcccgctccatgatcaccaactggtacttcgacgtctggggcgccggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15940 - RNA, 639 nt, synthetic construct
  misc_feature 1..639: note = derived and/or modified sequence opt2 from Palivizumab_LightChain
  source 1..639: mol_type = other RNA
gacatccagatgacccagtccccctccaccctctccgcctccgtcggcgaccgcgtcaccatcacctgcaagtgccagctctccgtcggctacatgcactggtaccagcagaagcccggcaaggcccccaagctcctcatctacgacacctccaagctcgcctccggcgtcccctcccgcttctccggctccggctccggcaccgagttcaccctcaccatctcctccctccagcccgacgacttcgccacctactactgcttccagggctccggctaccccttcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15941 - RNA, 360 nt, synthetic construct
  misc_feature 1..360: note = derived and/or modified sequence opt2 from Palivizumab_VH-Region
  source 1..360: mol_type = other RNA
caggtcaccctccgcgagtccggccccgccctcgtcaagcccacccagaccctcaccctcacctgcaccttctccggcttctccctctccacctccggcatgtccgtcggctggatccgccagccccccggcaaggccctcgagtggctcgccgacatctggtgggacgacaagaaggactacaacccctccctcaagtcccgcctcaccatctccaaggacacctccaagaaccaggtcgtcctcaaggtcaccaacatggaccccgccgacaccgccacctactactgcgcccgctccatgatcaccaactggtacttcgacgtctggggcgccggcaccaccgtcaccgtctcctcc

SEQ ID NO: 15942 - RNA, 1347 nt, synthetic construct; identical to SEQ ID NO: 15578
  misc_feature 1..1347: note = derived and/or modified sequence opt2 from Pamrevlumab_HeavyChain1
  source 1..1347: mol_type = other RNA

SEQ ID NO: 15943 - RNA, 642 nt, synthetic construct; identical to SEQ ID NO: 15579
  misc_feature 1..642: note = derived and/or modified sequence opt2 from Pamrevlumab_LightChain1
  source 1..642: mol_type = other RNA

SEQ ID NO: 15944 - RNA, 1305 nt, synthetic construct
  misc_feature 1..1305: note = derived and/or modified sequence opt2 from Panitumumab_HeavyChain1
  source 1..1305: mol_type = other RNA
caggtccagctccaggagtccggccccggcctcgtcaagccctccgagaccctctccctcacctgcaccgtctccggcggctccgtctcctccggcgactactactggacctggatccgccagtcccccggcaagggcctcgagtggatcggccacatctactactccggcaacaccaactacaacccctccctcaagtcccgcctcaccatctccatcgacacctccaagacccagttctccctcaagctctcctccgtcaccgccgccgacaccgccatctactactgcgtccgcgaccgcgtcaccggcgccttcgacatctggggccagggcaccatggtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacgagcgcaagtgctgcgtcgagtgccccgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15945 - RNA, 642 nt, synthetic construct
  misc_feature 1..642: note = derived and/or modified sequence opt2 from Panitumumab_LightChain1
  source 1..642: mol_type = other RNA
gacatccagatgacccagtccccctcctccctctccgcctccgtcggcgaccgcgtcaccatcacctgccaggcctcccaggacatctccaactacctcaactggtaccagcagaagcccggcaaggcccccaagctcctcatctacgacgcctccaacctcgagaccggcgtcccctcccgcttctccggctccggctccggcaccgacttcaccttcaccatctcctccctccagcccgaggacatcgccacctacttctgccagcacttcgaccacctccccctcgccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15946 - RNA, 1326 nt, synthetic construct
  misc_feature 1..1326: note = derived and/or modified sequence opt2 from Pankoab_HeavyChain1
  source 1..1326: mol_type = other RNA
gaggtccagctcgtcgagtccggcggcggcctcgtccagcccggcggctcccgcctctcctgcgtcgcctccggcttccccttctccaactactggaactgggtccgccaggcccccggcaagggcctcgagtgggtcggcgagatccgcctcaagtccaacaactacaccacccactacgccgagtccgtcaagggccgcttcaccatctcccgcgacgactccaagaactccctctacctccagaactccctcaagaccgaggacaccgccgtctactactgcacccgccactactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgagggcctccacaaccactacacccagaagtccctctccctctcccccggcaag

SEQ ID NO: 15947 - RNA, 651 nt, synthetic construct
  misc_feature 1..651: note = derived and/or modified sequence opt2 from Pankoab_LightChain1
  source 1..651: mol_type = other RNA
gacatcgtcacccagtcccccctctccaaccccgtcacccccggcgagcccgcctccatctcctgccgctcctccaagtccctcctccactccaacggcatcacctacttcttctggtacctccagaagcccggccagtccccccagctcctcatctaccagtccaacctcgcctccggcgtccccgaccgcttctccggctccggctccggcaccgacttcaccctccgcatctcccgcgtcgaggccgaggacgtcggcgtctactactgcgcccagaacctcgagctcccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15948 - RNA, 651 nt, synthetic construct
  misc_feature 1..651: note = derived and/or modified sequence opt2 from Pankoab_LightChain2
  source 1..651: mol_type = other RNA
gacatcgtcacccagtcccccctctccaaccccgtcacccccggcgagcccgcctccatctcctgccgctcctccaagtccctcctccactccaacggcatcacctacttcttctggtacctccagaagcccggccagtccccccagctcctcatctaccagtccaacctcgcctccggcgtccccgaccgcttctccggctccggctccggcaccgacttcaccctccgcatctcccgcgtcgaggccgaggacgtcggcgtctactactgcgccggcaacctcgagctcccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15949 - RNA, 351 nt, synthetic construct
  misc_feature 1..351: note = derived and/or modified sequence opt2 from PankoMab_HeavyChain_VDJ-Region
  source 1..351: mol_type = other RNA
gaggtcaagctcgtcgagtccggcggcggcctcgtccagcccggcggctccatgaagctctcctgcgtcgcctccggcttcaccttctccaactactggatgaactgggtccgccagtcccccgagaagggcctcgagtgggtcgccgagatccgcctcaagtccaacaactacaccacccactacgccgagtccgtcaagggccgcttcaccatctcccgcgacgactccaagtcctccgtctccctccagatgaacaacctccgcgtcgaggacaccggcatctactactgcacccgccactactacttcgactactggggccagggcaccaccctcaccgtctcctcc

SEQ ID NO: 15950 - RNA, 339 nt, synthetic construct
  misc_feature 1..339: note = derived and/or modified sequence opt2 from PankoMab_LightChain_VJ-Region
  source 1..339: mol_type = other RNA
gacatcgtcatgacccaggccgccttctccaaccccgtcaccctcggcacctccgcctccatctcctgccgctcctccaagtccctcctccactccaacggcatcacctacttcttctggtacctccagaagcccggcctctccccccagctcctcatctaccagatgtccaacctcgcctccggcgtccccgaccgcttctcctcctccggctccggcaccgacttcaccctccgcatctcccgcgtcgaggccgaggacgtcggcgtctactactgcgcccagaacctcgagctcccccccaccttcggcggcggcaccaagctcgagatcaagcgc

SEQ ID NO: 15951 - RNA, 1707 nt, synthetic construct
  misc_feature 1..1707: note = derived and/or modified sequence opt2 from Panobacumab_HeavyChain1
  source 1..1707: mol_type = other RNA
gaggagcaggtcgtcgagtccggcggcggcttcgtccagcccggcggctccctccgcctctcctgcgccgcctccggcttcaccttctccccctactggatgcactgggtccgccaggcccccggcaagggcctcgtctgggtctcccgcatcaactccgacggctccacctactacgccgactccgtcaagggccgcttcaccatctcccgcgacaacgcccgcaacaccctctacctccagatgaactccctccgcgccgaggacaccgccgtctactactgcgcccgcgaccgctactacggccccgagatgtggggccagggcaccatggtcaccgtctcctccggctccgcctccgcccccaccctcttccccctcgtctcctgcgagaactccccctccgacacctcctccgtcgccgtcggctgcctcgcccaggacttcctccccgactccatcaccttctcctggaagtacaagaacaactccgacatctcctccacccgcggcttcccctccgtcctccgcggcggcaagtacgccgccacctcccaggtcctcctcccctccaaggacgtcatgcagggcaccgacgagcacgtcgtctgcaaggtccagcaccccaacggcaacaaggagaagaacgtccccctccccgtcatcgccgagctcccccccaaggtctccgtcttcgtccccccccgcgacggcttcttcggcaacccccgcaagtccaagctcatctgccaggccaccggcttctccccccgccagatccaggtctcctggctccgcgagggcaagcaggtcggctccggcgtcaccaccgaccaggtccaggccgaggccaaggagtccggccccaccacctacaaggtcacctccaccctcaccatcaaggagtccgactggctctcccagtccatgttcacctgccgcgtcgaccaccgcggcctcaccttccagcagaacgcctcctccatgtgcgtccccgaccaggacaccgccatccgcgtcttcgccatccccccctccttcgcctccatcttcctcaccaagtccaccaagctcacctgcctcgtcaccgacctcaccacctacgactccgtcaccatctcctggacccgccagaacggcgaggccgtcaagacccacaccaacatctccgagtcccaccccaacgccaccttctccgccgtcggcgaggcctccatctgcgaggacgactggaactccggcgagcgcttcacctgcaccgtcacccacaccgacctcccctcccccctcaagcagaccatctcccgccccaagggcgtcgccctccaccgccccgacgtctacctcctcccccccgcccgcgagcagctcaacctccgcgagtccgccaccatcacctgcctcgtcaccggcttctcccccgccgacgtcttcgtccagtggatgcagcgcggccagcccctctcccccgagaagtacgtcacctccgcccccatgcccgagccccaggcccccggccgctacttcgcccactccatcctcaccgtctccgaggaggagtggaacaccggcgagacctacacctgcgtcgtcgcccacgaggccctccccaaccgcgtcaccgagcgcaccgtcgacaagtccaccggcaagcccaccctctacaacgtctccctcgtcatgtccgacaccgccggcacctgctac

SEQ ID NO: 15952 - RNA, 657 nt, synthetic construct
  misc_feature 1..657: note = derived and/or modified sequence opt2 from Panobacumab_LightChain1
  source 1..657: mol_type = other RNA
gacgtcgtcatgacccagtcccccctctccctccccgtcaccctcggccagcccgcctccatctcctgccgctcctcccagtccctcgtctactccgacggcaacacctacctcaactggttccagcagcgccccggccagtccccccgccgcctcatctacaaggtctccaaccgcgactccggcgtccccgaccgcttctccggctccggctccggcaccgacttcaccctcaagatctcccgcgtcgaggccgaggacgtcggcgtctactactgcatgcagggcacccactggcccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15953 - RNA, 414 nt, synthetic construct
  misc_feature 1..414: note = derived and/or modified sequence opt2 from Panobacumab_LightChain2
  source 1..414: mol_type = other RNA
ggcgacgacgaggccaccatcctcgccgacaacaagtgcatgtgcacccgcgtcacctcccgcatcatcccctccaccgaggaccccaacgaggacatcgtcgagcgcaacatccgcatcgtcgtccccctcaacaaccgcgagaacatctccgaccccacctcccccctccgccgcaacttcgtctaccacctctccgacgtctgcaagaagtgcgaccccgtcgaggtcgagctcgaggaccaggtcgtcaccgccacccagtccaacatctgcaacgaggacgacggcgtccccgagacctgctacatgtacgaccgcaacaagtgctacaccaccatggtccccctccgctaccacggcgagaccaagatggtccaggccgccctcacccccgactcctgctaccccgac

SEQ ID NO: 15954 - RNA, 1359 nt, synthetic construct
  misc_feature 1..1359: note = derived and/or modified sequence opt2 from Parsatuzumab_HeavyChain1
  source 1..1359: mol_type = other RNA
gaggtccagctcgtcgagtccggcggcggcctcgtccagcccggcggctccctccgcctctcctgcgccgcctccggctacaccttcatcgactactacatgaactgggtccgccaggcccccggcaagggcctcgagtgggtcggcgacatcaacctcgacaactccggcacccactacaaccagaagttcaagggccgcttcaccatctcccgcgacaagtccaagaacaccgcctacctccagatgaactccctccgcgccgaggacaccgccgtctactactgcgcccgcgagggcgtctaccacgactacgacgactacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15955 - RNA, 657 nt, synthetic construct
  misc_feature 1..657: note = derived and/or modified sequence opt2 from Parsatuzumab_LightChain1
  source 1..657: mol_type = other RNA
gacatccagatgacccagtccccctcctccctctccgcctccgtcggcgaccgcgtcaccatcacctgccgcacctcccagtccctcgtccacatcaacgccatcacctacctccactggtaccagcagaagcccggcaaggcccccaagctcctcatctaccgcgtctccaaccgcttctccggcgtcccctcccgcttctccggctccggctccggcaccgacttcaccctcaccatctcctccctccagcccgaggacttcgccacctactactgcggccagtccacccacgtccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15956 - RNA, 1353 nt, synthetic construct
  misc_feature 1..1353: note = derived and/or modified sequence opt2 from Pascolizumab_HeavyChain1
  source 1..1353: mol_type = other RNA
caggtcaccctccgcgagtccggccccgccctcgtcaagcccacccagaccctcaccctcacctgcaccttctccggcttctccctctccacctccggcatgggcgtctcctggatccgccagccccccggcaagggcctcgagtggctcgcccacatctactgggacgacgacaagcgctacaacccctccctcaagtcccgcctcaccatctccaaggacacctcccgcaaccaggtcgtcctcaccatgaccaacatggaccccgtcgacaccgccacctactactgcgcccgccgcgagaccgtcttctactggtacttcgacgtctggggccgcggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15957 - RNA, 654 nt, synthetic construct
  misc_feature 1..654: note = derived and/or modified sequence opt2 from Pascolizumab_LightChain1
  source 1..654: mol_type = other RNA
gacatcgtcctcacccagtccccctcctccctctccgcctccgtcggcgaccgcgtcaccatcacctgcaaggcctcccagtccgtcgactacgacggcgactcctacatgaactggtaccagcagaagcccggcaaggcccccaagctcctcatctacgccgcctccaacctcgagtccggcatcccctcccgcttctccggctccggctccggcaccgacttcaccttcaccatctcctccctccagcccgaggacatcgccacctactactgccagcagtccaacgaggacccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15958 - RNA, 1512 nt, synthetic construct
  misc_feature 1..1512: note = derived and/or modified sequence opt2 from Pasotuxizumab_HeavyChain1
  source 1..1512: mol_type = other RNA
caggtccagctcgtcgagtccggcggcggcctcgtcaagcccggcgagtccctccgcctctcctgcgccgcctccggcttcaccttctccgactactacatgtactgggtccgccaggcccccggcaagggcctcgagtgggtcgccatcatctccgacggcggctactacacctactactccgacatcatcaagggccgcttcaccatctcccgcgacaacgccaagaactccctctacctccagatgaactccctcaaggccgaggacaccgccgtctactactgcgcccgcggcttccccctcctccgccacggcgccatggactactggggccagggcaccctcgtcaccgtctcctccggcggcggcggctccggcggcggcggctccggcggcggcggctccgacatccagatgacccagtccccctcctccctctccgcctccgtcggcgaccgcgtcaccatcacctgcaaggcctcccagaacgtcgacaccaacgtcgcctggtaccagcagaagcccggccaggcccccaagtccctcatctactccgcctcctaccgctactccgacgtcccctcccgcttctccggctccgcctccggcaccgacttcaccctcaccatctcctccgtccagtccgaggacttcgccacctactactgccagcagtacgactcctacccctacaccttcggcggcggcaccaagctcgagatcaagtccggcggcggcggctccgaggtccagctcgtcgagtccggcggcggcctcgtccagcccggcggctccctcaagctctcctgcgccgcctccggcttcaccttcaacaagtacgccatgaactgggtccgccaggcccccggcaagggcctcgagtgggtcgcccgcatccgctccaagtacaacaactacgccacctactacgccgactccgtcaaggaccgcttcaccatctcccgcgacgactccaagaacaccgcctacctccagatgaacaacctcaagaccgaggacaccgccgtctactactgcgtccgccacggcaacttcggcaactcctacatctcctactgggcctactggggccagggcaccctcgtcaccgtctcctccggcggcggcggctccggcggcggcggctccggcggcggcggctcccagaccgtcgtcacccaggagccctccctcaccgtctcccccggcggcaccgtcaccctcacctgcggctcctccaccggcgccgtcacctccggcaactaccccaactgggtccagcagaagcccggccaggccccccgcggcctcatcggcggcaccaagttcctcgcccccggcacccccgcccgcttctccggctccctcctcggcggcaaggccgccctcaccctctccggcgtccagcccgaggacgaggccgagtactactgcgtcctctggtactccaaccgctgggtcttcggcggcggcaccaagctcaccgtcctccaccaccaccaccaccac

SEQ ID NO: 15959 - RNA, 1512 nt, synthetic construct
  misc_feature 1..1512: note = derived and/or modified sequence opt2 from Pasotuxizumab_SingleChain
  source 1..1512: mol_type = other RNA
caggtccagctcgtccagtccggcggcggcctcgtcaagcccggcgagtccctccgcctctcctgcgccgcctccggcttcaccttctccgactactacatgtactgggtccgccaggcccccggcaagggcctcgagtgggtcgccatcatctccgacggcggctactacacctactactccgacatcatcaagggccgcttcaccatctcccgcgacaacgccaagaactccctctacctccagatgaactccctcaaggccgaggacaccgccgtctactactgcgcccgcggcttccccctcctccgccacggcgccatggactactggggccagggcaccctcgtcaccgtctcctccggcggcggcggctccggcggcggcggctccggcggcggcggctccgacatccagatgacccagtccccctcctccctctccgcctccgtcggcgaccgcgtcaccatcacctgcaaggcctcccagaacgtcgacaccaacgtcgcctggtaccagcagaagcccggccaggcccccaagtccctcatctactccgcctcctaccgctactccgacgtcccctcccgcttctccggctccgcctccggcaccgacttcaccctcaccatctcctccgtccagtccgaggacttcgccacctactactgccagcagtacgactcctacccctacaccttcggcggcggcaccaagctcgagatcaagtccggcggcggcggctccgaggtccagctcgtcgagtccggcggcggcctcgtccagcccggcggctccctcaagctctcctgcgccgcctccggcttcaccttcaacaagtacgccatgaactgggtccgccaggcccccggcaagggcctcgagtgggtcgcccgcatccgctccaagtacaacaactacgccacctactacgccgactccgtcaaggaccgcttcaccatctcccgcgacgactccaagaacaccgcctacctccagatgaacaacctcaagaccgaggacaccgccgtctactactgcgtccgccacggcaacttcggcaactcctacatctcctactgggcctactggggccagggcaccctcgtcaccgtctcctccggcggcggcggctccggcggcggcggctccggcggcggcggctcccagaccgtcgtcacccaggagccctccctcaccgtctcccccggcggcaccgtcaccctcacctgcggctcctccaccggcgccgtcacctccggcaactaccccaactgggtccagcagaagcccggccaggccccccgcggcctcatcggcggcaccaagttcctcgcccccggcacccccgcccgcttctccggctccctcctcggcggcaaggccgccctcaccctctccggcgtccagcccgaggacgaggccgagtactactgcgtcctctggtactccaaccgctgggtcttcggcggcggcaccaagctcaccgtcctccaccaccaccaccaccac

SEQ ID NO: 15960 - RNA, 1341 nt, synthetic construct
  misc_feature 1..1341: note = derived and/or modified sequence opt2 from Pateclizumab_HeavyChain1
  source 1..1341: mol_type = other RNA
gaggtccagctcgtcgagtccggcggcggcctcgtccagcccggcggctccctccgcctctcctgcgccgcctccggctacaccttcacctcctacgtcatccactgggtccgccaggcccccggcaagggcctcgagtgggtcggctacaacaacccctacaacgccggcaccaactacaacgagaagttcaagggccgcttcaccatctcctccgacaagtccaagaacaccgcctacctccagatgaactccctccgcgccgaggacaccgccgtctactactgctcccgccccaccatgctcccctggttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15961 - RNA, 642 nt, synthetic construct
  misc_feature 1..642: note = derived and/or modified sequence opt2 from Pateclizumab_LightChain1
  source 1..642: mol_type = other RNA
gacatccagatgacccagtccccctcctccctctccgcctccgtcggcgaccgcgtcaccatcacctgccgcgcctcccaggccgtctcctccgccgtcgcctggtaccagcagaagcccggcaaggcccccaagctcctcatctactccgcctcccaccgctacaccggcgtcccctcccgcttctccggctccggctccggcaccgacttcaccctcaccatctcctccctccagcccgaggacttcgccacctactactgccaggagtcctactccaccccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15962 - RNA, 1341 nt, synthetic construct
  misc_feature 1..1341: note = derived and/or modified sequence opt2 from Patritumab_HeavyChain1
  source 1..1341: mol_type = other RNA
caggtccagctccagcagtggggcgccggcctcctcaagccctccgagaccctctccctcacctgcgccgtctacggcggctccttctccggctactactggtcctggatccgccagccccccggcaagggcctcgagtggatcggcgagatcaaccactccggctccaccaactacaacccctccctcaagtcccgcgtcaccatctccgtcgagacctccaagaaccagttctccctcaagctctcctccgtcaccgccgccgacaccgccgtctactactgcgcccgcgacaagtggacctggtacttcgacctctggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15963 - RNA, 681 nt, synthetic construct; identical to SEQ ID NO: 15919
  misc_feature 1..681: note = derived and/or modified sequence opt2 from Patritumab_hinge-CH2-CH3
  source 1..681: mol_type = other RNA

SEQ ID NO: 15964 - RNA, 660 nt, synthetic construct
  misc_feature 1..660: note = derived and/or modified sequence opt2 from Patritumab_LightChain1
  source 1..660: mol_type = other RNA
gacatcgagatgacccagtcccccgactccctcgccgtctccctcggcgagcgcgccaccatcaactgccgctcctcccagtccgtcctctactcctcctccaaccgcaactacctcgcctggtaccagcagaaccccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagtactactccaccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15965 - RNA, 1341 nt, synthetic construct; identical to SEQ ID NO: 15780
  misc_feature 1..1341: note = derived and/or modified sequence opt2 from Pembrolizumab_HeavyChain1
  source 1..1341: mol_type = other RNA

SEQ ID NO: 15966 - RNA, 654 nt, synthetic construct; identical to SEQ ID NO: 15781
  misc_feature 1..654: note = derived and/or modified sequence opt2 from Pembrolizumab_LightChain1
  source 1..654: mol_type = other RNA

SEQ ID NO: 15967 - RNA, 1356 nt, synthetic construct
  misc_feature 1..1356: note = derived and/or modified sequence opt2 from Perakizumab_HeavyChain1
  source 1..1356: mol_type = other RNA
gaggtccagctcgtcgagtccggcggcggcctcgtccagcccggcggctccctccgcctctcctgcgccgcctccggcttcaccttctccgactacaccatgctctgggtccgccaggcccccggcaagggcctcgagtgggtcgccatcatcaagtccggcggctcctactcctactaccccgactccgtcaagggccgcttcaccatctcccgcgacaacgccaagaactccctctacctccagatgaactccctccgcgccgaggacaccgccgtctactactgcgcccgcgacggcgactacggctcctcctacggcgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15968 - RNA, 645 nt, synthetic construct
  misc_feature 1..645: note = derived and/or modified sequence opt2 from Perakizumab_LightChain1
  source 1..645: mol_type = other RNA
gacatccagatgacccagtccccctcctccctctccgcctccgtcggcgaccgcgtcaccatcacctgccgcgcctcccaggacatcaactcctacctctcctggttccagcagaagcccggcaaggcccccaagtccctcatcgtccgcgccaaccgcctcgtcgacggcgtcccctcccgcttctccggctccggctccggccaggactactccctcaccatctcctccctccagcccgaggacttcgccacctactactgcctccagtacgacgccttccccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15969 - RNA, 1332 nt, synthetic construct
  misc_feature 1..1332: note = derived and/or modified sequence opt2 from Pertuzuab_HeavyChain1
  source 1..1332: mol_type = other RNA
gaggtccagctcgtcgagtccggcggcggcctcgtccagcccggcggctccctccgcctctcctgcgccgcctccggcttcaccttcaccgactacaccgactgggtccgccaggcccccggcaagggcctcgagtgggtcgccgacgtcaaccccaactccggcggctccatctacaaccagcgcttcaagggccgcttcaccctctccgtcgaccgctccaagaacaccctctacctccagaactccctccgcgccgaggacaccgccgtctactactgcgcccgcaacctcggcccctccttctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 15970 - RNA, 639 nt, synthetic construct
  misc_feature 1..639: note = derived and/or modified sequence opt2 from Pertuzuab_LightChain1
  source 1..639: mol_type = other RNA
gacatccagacccagtccccctcctccctctccgcctccgtcggcgaccgcgtcaccatcacctgcaaggcctcccaggacgtctccatcggcgtcgcctggtaccagcagaagcccggcaaggcccccaagctcctcatctactccgcctcctaccgctacaccggcgtcccctcccgcttctccggctccggctccggcaccgacttcaccctcaccatctcctccctccagcccgaggacttcgccacctactactgccagcagtactacatctacccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15971 - RNA, 642 nt, synthetic construct
  misc_feature 1..642: note = derived and/or modified sequence opt2 from Pertuzumab_HeavyChain
  source 1..642: mol_type = other RNA
gacatccagatgacccagtccccctcctccctctccgcctccgtcggcgaccgcgtcaccatcacctgcaaggcctcccaggacgtctccatcggcgtcgcctggtaccagcagaagcccggcaaggcccccaagctcctcatctactccgcctcctaccgctacaccggcgtcccctcccgcttctccggctccggctccggcaccgacttcaccctcaccatctcctccctccagcccgaggacttcgccacctactactgccagcagtactacatctacccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15972 - RNA, 1344 nt, synthetic construct
  misc_feature 1..1344: note = derived and/or modified sequence opt2 from Pertuzumab_LightChain
  source 1..1344: mol_type = other RNA
gaggtccagctcgtcgagtccggcggcggcctcgtccagcccggcggctccctccgcctctcctgcgccgcctccggcttcaccttcaccgactacaccatggactgggtccgccaggcccccggcaagggcctcgagtgggtcgccgacgtcaaccccaactccggcggctccatctacaaccagcgcttcaagggccgcttcaccctctccgtcgaccgctccaagaacaccctctacctccagatgaactccctccgcgccgaggacaccgccgtctactactgcgcccgcaacctcggcccctccttctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 15973 - RNA, 750 nt, synthetic construct
  misc_feature 1..750: note = derived and/or modified sequence opt2 from Pexelizumab_h5g1.1-scFv
  source 1..750: mol_type = other RNA
atggccgacatccagatgacccagtccccctcctccctctccgcctccgtcggcgaccgcgtcaccatcacctgcggcgcctccgagaacatctacggcgccctcaactggtaccagcgcaagcccggcaaggcccccaagctcctcatctacggcgccaccaacctcgccgacggcgtcccctcccgcttctccggctccggctccggcaccgactacaccctcaccatctcctccctccagcccgaggacttcgccacctactactgccagaacgtcctcaacacccccctcaccttcggccagggcaccaaggtcgagatcaagcgcaccggcggcggcggctccggcggcggcggctccggcggcggcggctcccaggtccagctcgtccagtccggcgccgaggtcgagaagcccggcgcctccgtcaagaaggtctcctgcaaggcctccggctacatcttctccaactactggatccagtgggtccgccaggcccccggccagggcctcgagtggatgggcgagatcctccccggctccggctccaccgagtacgcccagaagttccagggccgcgtcaccatgaccgccgacacctccacctccaccgcctacatggagctctcctccctccgctccgaggacaccgccgtctactactgcgcccgctacttcttcggctcctcccccaactactggtacttcgacgtctggggccagggcaccctcgtcaccgtctcctcc

SEQ ID NO: 15974 - RNA, 345 nt, synthetic construct
  misc_feature 1..345: note = derived and/or modified sequence opt2 from Pexelizumab_h5g1.1VHC_+_F_Heavy_Chain_V-Region
  source 1..345: mol_type = other RNA
caggtccagctcgtccagtccggcgccgaggtcaagaagcccggcgcctccgtcaaggtctcctgcaaggcctccggctacatcttctccaactactggatccagtgggtccgccaggcccccggccagggcctcgagtggatgggcgagatcctccccggctccggctccaccgagtacgcccagaagttccagggccgcgtcaccatgaccgccgacacctccacctccaccgcctacatggagctctcctccctccgctccgaggacaccgccgtctactactgcgcccgctacttcttcggctcctcccccaactggtacttcgtctggggccagggcacc

SEQ ID NO: 15975 - RNA, 318 nt, synthetic construct
  misc_feature 1..318: note = derived and/or modified sequence opt2 from Pexelizumab_h5g1.1VHC_+_F_Light_Chain_V-Region
  source 1..318: mol_type = other RNA
gacatccagatgacccagtccccctccctctccgcctccgtcggcgaccgcgtcaccatcacctgcggcgcctccgagaacatctacggcgccctcaactggtaccagcgcaagcccggcaaggcccccaagctcctcatctacggcgccaccaacctcgccgacggcgtcccctcccgcttctccggctccggctccggcaccgactacaccctcaccatctcctccctccagcccgaggacttcgccacctactactgccagaacgtcctcaacacccccctcaccttcggccagggcaccaaggtcgagatcaag

SEQ ID NO: 15976 - RNA, 1326 nt, synthetic construct
  misc_feature 1..1326: note = derived and/or modified sequence opt2 from PF-05082566_HeavyChain1
  source 1..1326: mol_type = other RNA
gaggtccagctcgtccagtccggcgccgaggtcaagaagcccggcgagtccctccgcatctcctgcaagggctccggctactccttctccacctactggatctcctgggtccgccagatgcccggcaagggcctcgagtggatgggcaagatctaccccggcgactcctacaccaactactccccctccttccagggccaggtcaccatctccgccgacaagtccatctccaccgcctacctccagtggtcctccctcaaggcctccgacaccgccatgtactactgcgcccgcggctacggcatcttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15977 - RNA, 642 nt, synthetic construct
  misc_feature 1..642: note = derived and/or modified sequence opt2 from PF-05082568_LightChain1
  source 1..642: mol_type = other RNA
tcctacgagctcacccagcccccctccgtctccgtctcccccggccagaccgcctccatcacctgctccggcgacaacatcggcgaccagtacgcccactggtaccagcagaagcccggccagtcccccgtcctcgtcatctaccaggacaagaaccgcccctccggcatccccgagcgcttctccggctccaactccggcaacaccgccaccctcaccatctccggcacccaggccatggacgaggccgactactactgcgccacctacaccggcttcggctccctcgccgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 15978 - RNA, 1341 nt, synthetic construct
  misc_feature 1..1341: note = derived and/or modified sequence opt2 from Pidilizumab_HeavyChain1
  source 1..1341: mol_type = other RNA
caggtccagctcgtccagtccggctccgagctcaagaagcccggcgcctccgtcaagatctcctgcaaggcctccggctacaccttcaccaactacggcatgaactgggtccgccaggcccccggccagggcctccagtggatgggctggatcaacaccgactccggcgagtccacctacgccgaggagttcaagggccgcttcgtcttctccctcgacacctccgtcaacaccgcctacctccagatcacctccctcaccgccgaggacaccggcatgtacttctgcgtccgcgtcggctacgacgccctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15979 - RNA, 639 nt, synthetic construct
  misc_feature 1..639: note = derived and/or modified sequence opt2 from Pidilizumab_LightChain1
  source 1..639: mol_type = other RNA
gagatcgtcctcacccagtccccctcctccctctccgcctccgtcggcgaccgcgtcaccatcacctgctccgcccgctcctccgtctcctacatgcactggttccagcagaagcccggcaaggcccccaagctctggatctaccgcacctccaacctcgcctccggcgtcccctcccgcttctccggctccggctccggcacctcctactgcctcaccatcaactccctccagcccgaggacttcgccacctactactgccagcagcgctcctccttccccctcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15980 - RNA, 1350 nt, synthetic construct
  misc_feature 1..1350: note = derived and/or modified sequence opt2 from Pinatuzumab_vedotin_HeavyChain1
  source 1..1350: mol_type = other RNA
gaggtccagctcgtcgagtccggcggcggcctcgtccagcccggcggctccctccgcctctcctgcgccgcctccggctacgagttctcccgctcctggatgaactgggtccgccaggcccccggcaagggcctcgagtgggtcggccgcatctaccccggcgacggcgacaccaactactccggcaagttcaagggccgcttcaccatctccgccgacacctccaagaacaccgcctacctccagatgaactccctccgcgccgaggacaccgccgtctactactgcgcccgcgacggctcctcctgggactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15981 - RNA, 657 nt, synthetic construct
  misc_feature 1..657: note = derived and/or modified sequence opt2 from Pinatuzumab_vedotin_LightChain1
  source 1..657: mol_type = other RNA
gacatccagatgacccagtccccctcctccctctccgcctccgtcggcgaccgcgtcaccatcacctgccgctcctcccagtccatcgtccactccgtcggcaacaccttcctcgagtggtaccagcagaagcccggcaaggcccccaagctcctcatctacaaggtctccaaccgcttctccggcgtcccctcccgcttctccggctccggctccggcaccgacttcaccctcaccatctcctccctccagcccgaggacttcgccacctactactgcttccagggctcccagttcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15982 - RNA, 1023 nt, synthetic construct
  misc_feature 1..1023: note = derived and/or modified sequence opt2 from Placulumab_chain1
  source 1..1023: mol_type = other RNA
gacatccagatgacccagtccccctcctccctctccgcctccgtcggcgaccgcgtcaccatcacctgccgcgcctcccaggccatcgactcctacctccactggtaccagcagaagcccggcaaggcccccaagctcctcatctactccgcctccaacctcgagaccggcgtcccctcccgcttctccggctccggctccggcaccgacttcaccctcaccatctcctccctcctccccgaggacttcgccacctactactgccagcaggtcgtctggcgccccttcaccttcggccagggcaccaaggtcgagatcaagcgcgtcgagcccaagtcctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15983 - RNA, 1023 nt, synthetic construct; identical to SEQ ID NO: 15982
  misc_feature 1..1023: note = derived and/or modified sequence opt2 from Placulumab_HeavyChain1
  source 1..1023: mol_type = other RNA

SEQ ID NO: 15984 - RNA, 1341 nt, synthetic construct
  misc_feature 1..1341: note = derived and/or modified sequence opt2 from Plozalizumab_HeavyChain1
  source 1..1341: mol_type = other RNA
gaggtccagctcgtcgagtccggcggcggcctcgtcaagcccggcggctccctccgcctctcctgcgccgcctccggcttcaccttctccgcctacgccatgaactgggtccgccaggcccccggcaagggcctcgagtgggtcggccgcatccgcaccaagaacaacaactacgccacctactacgccgactccgtcaaggaccgcttcaccatctcccgcgacgactccaagaacaccctctacctccagatgaactccctcaagaccgaggacaccgccgtctactactgcaccaccttctacggcaacggcgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15985 - RNA, 657 nt, synthetic construct
  misc_feature 1..657: note = derived and/or modified sequence opt2 from Plozalizumab_LightChain1
  source 1..657: mol_type = other RNA
gacgtcgtcatgacccagtcccccctctccctccccgtcaccctcggccagcccgcctccatctcctgcaagtcctcccagtccctcctcgactccgacggcaagaccttcctcaactggttccagcagcgccccggccagtccccccgccgcctcatctacctcgtctccaagctcgactccggcgtccccgaccgcttctccggctccggctccggcaccgacttcaccctcaagatctcccgcgtcgaggccgaggacgtcggcgtctactactgctggcagggcacccacttcccctacaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15986 - RNA, 1341 nt, synthetic construct
  misc_feature 1..1341: note = derived and/or modified sequence opt2 from Pogalizumab_HeavyChain1
  source 1..1341: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15987 - RNA, 642 nt, synthetic construct
  misc_feature 1..642: note = derived and/or modified sequence opt2 from Pogalizumab_LightChain1
  source 1..642: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggccacaccctcccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15988 - RNA, 1341 nt, synthetic construct
  misc_feature 1..1341: note = derived and/or modified sequence opt2 from Polatuzumab_vedotin_HeavyChain1
  source 1..1341: mol_type = other RNA
gaggtccagctcgtcgagtccggcggcggcctcgtccagcccggcggctccctccgcctctcctgcgccgcctccggctacaccttctcctcctactggatcgagtgggtccgccaggcccccggcaagggcctcgagtggatcggcgagatcctccccggcggcggcgacaccaactacaacgagatcttcaagggccgcgccaccttctccgccgacacctccaagaacaccgcctacctccagatgaactccctccgcgccgaggacaccgccgtctactactgcacccgccgcgtccccatccgcctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15989 - RNA, 654 nt, synthetic construct
  misc_feature 1..654: note = derived and/or modified sequence opt2 from Polatuzumab_vedotin_LightChain1
  source 1..654: mol_type = other RNA
gacatccagctcacccagtccccctcctccctctccgcctccgtcggcgaccgcgtcaccatcacctgcaaggcctcccagtccgtcgactacgagggcgactccttcctcaactggtaccagcagaagcccggcaaggcccccaagctcctcatctacgccgcctccaacctcgagtccggcgtcccctcccgcttctccggctccggctccggcaccgacttcaccctcaccatctcctccctccagcccgaggacttcgccacctactactgccagcagtccaacgaggaccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15990 - RNA, 1326 nt, synthetic construct
  misc_feature 1..1326: note = derived and/or modified sequence opt2 from Ponezumab_HeavyChain1
  source 1..1326: mol_type = other RNA
caggtccagctcgtccagtccggcgccgaggtcaagaagcccggcgcctccgtcaaggtctcctgcaaggcctccggctactacaccgaggcctactacatccactgggtccgccaggcccccggccagggcctcgagtggatgggccgcatcgaccccgccaccggcaacaccaagtacgccccccgcctccaggaccgcgtcaccatgacccgcgacacctccacctccaccgtctacatggagctctcctccctccgctccgaggacaccgccgtctactactgcgcctccctctactccctccccgtctactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15991 - RNA, 657 nt, synthetic construct
  misc_feature 1..657: note = derived and/or modified sequence opt2 from Ponezumab_LightChain1
  source 1..657: mol_type = other RNA
gacgtcgtcatgacccagtcccccctctccctccccgtcaccctcggccagcccgcctccatctcctgcaagtcctcccagtccctcctctactccgacgccaagacctacctcaactggttccagcagcgccccggccagtccccccgccgcctcatctaccagatctcccgcctcgaccccggcgtccccgaccgcttctccggctccggctccggcaccgacttcaccctcaagatctcccgcgtcgaggccgaggacgtcggcgtctactactgcctccagggcacccactaccccgtcctcttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15992 - RNA, 1362 nt, synthetic construct
  misc_feature 1..1362: note = derived and/or modified sequence opt2 from Pritoxaximab_HeavyChain1
  source 1..1362: mol_type = other RNA
caggtccagctccaggagtccggcgccgagctcgtccgctccggcgcctccgtccgcatgtcctgcaaggcctccggctacaccttcacctcctacaacatgcactgggtcaagcagacccccggccagggcctcgagtggatcggctacatctaccccggcaacggcggcaccaactacatccagaagttcaagggcaaggccatcctcaccgccgacacctcctcctccaccgcctacatgcagatctcctccctcacctccgaggactccgccgtctacttctgcacccgctccccctcccactactcctccgacccctacttcgactactggggccagggcaccaccctcaccgtctcctccgagttcgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15993 - RNA, 642 nt, synthetic construct
  misc_feature 1..642: note = derived and/or modified sequence opt2 from Pritoxaximab_LightChain1
  source 1..642: mol_type = other RNA
gacatcgtcatgtcccagtcccacaagttcatgtccacctccgtcggcgaccgcgtctccatcacctgcaaggcctcccaggacgtcggcaccgccgtcgcctggtaccagcagaaccccggccagtcccccaagttcctcatctactgggcctccacccgccacaccggcgtccccgaccgcttcaccggctccggctccggcaccgacttcaccctcaccatcaccaacgtccagtccgaggacctcgccgactacttctgccagcagtactcctcctaccccctcaccttcggcgccggcacctccctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15994 - RNA, 1350 nt, synthetic construct
  misc_feature 1..1350: note = derived and/or modified sequence opt2 from Pritumumab_HeavyChain1
  source 1..1350: mol_type = other RNA
gaggtccagctcctcgagtccggcggcgacctcgtccagcccggcggctccctccgcctctcctgcgccgcctccggcttcaccttctccaactacgccatgtcctgggtccgccaggcccccggcaagggcctcgagtgggtctccgccatcaccccctccggcggctccaccaactacgccgactccgtcaagggccgcttcaccatctcccgcgacaactcccagaacaccctctacctccagatgaactccctccgcgtcgaggacaccgccgtctacatctgcggccgcgtcccctaccgctccacctggtaccccctctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15995 - RNA, 642 nt, synthetic construct
  misc_feature 1..642: note = derived and/or modified sequence opt2 from Pritumumab_LightChain1
  source 1..642: mol_type = other RNA
gacatccagatgacccagtccccctcctccctctccgcctccgtcggcgaccgcgtcaccatcacctgccgcgcctcccaggacatctccaactacctcgcctggttccagcagaagcccggcaaggcccccaagtccctcatctacgccgcctcctccctccactccaaggtccccacccagttctccggctccggctccggcaccgacttcaccctcaccatctcctccctccagcccgaggacttcgccacctactactgcctccagtactccacctaccccatcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15996 - RNA, 1341 nt, synthetic construct
  misc_feature 1..1341: note = derived and/or modified sequence opt2 from Quilizumab_HeavyChain1
  source 1..1341: mol_type = other RNA
gaggtccagctcgtcgagtccggcggcggcctcgtccagcccggcggctccctccgcctctcctgcgccgcctccggcttcaccttctccgactacggcatcgcctgggtccgccaggcccccggcaagggcctcgagtgggtcgccttcatctccgacctcgcctacaccatctactacgccgacaccgtcaccggccgcttcaccatctcccgcgacaactccaagaacaccctctacctccagatgaactccctccgcgccgaggacaccgccgtctactactgcgcccgcgacaactgggacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 15997 - RNA, 657 nt, synthetic construct
  misc_feature 1..657: note = derived and/or modified sequence opt2 from Quilizumab_LightChain1
  source 1..657: mol_type = other RNA
gacatccagatgacccagtccccctcctccctctccgcctccgtcggcgaccgcgtcaccatcacctgccgctcctcccagtccctcgtccacaacaacgccaacacctacctccactggtaccagcagaagcccggcaaggcccccaagctcctcatctacaaggtctccaaccgcttctccggcgtcccctcccgcttctccggctccggctccggcaccgacttcaccctcaccatctcctccctccagcccgaggacttcgccacctactactgctcccagaacaccctcgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 15998 - RNA, 1335 nt, synthetic construct
  misc_feature 1..1335: note = derived and/or modified sequence opt2 from Racotumomab_HeavyChain1
  source 1..1335: mol_type = other RNA
caggtccagctccagcagtccggcgccgagctcgtcaagcccggcgcctccgtcaagctctcctgcaaggcctccggctacaccttcacctcctacgacatcaactgggtccgccagcgccccgagcagggcctcgagtggatcggctggatcttccccggcgacggctccaccaagtacaacgagaagttcaagggcaaggccaccctcaccaccgacaagtcctcctccaccgcctacatgcagctctcccgcctcacctccgaggactccgccgtctacttctgcgcccgcgaggactactacgacaactcctactacttcgactactggggccagggcaccaccctcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccccccgcccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctggttcgtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatgaacaccaacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 15999 - RNA, 642 nt, synthetic construct
  misc_feature 1..642: note = derived and/or modified sequence opt2 from Racotumomab_LightChain1
  source 1..642: mol_type = other RNA
gacatccagatgacccagaccacctcctccctctccgcctccctcggcgaccgcgtcaccatctcctgccgcgcctcccaggacatctccaactacctcaactggtaccagcagaagcccgacggcaccgtcaagctcctcatctactacacctcccgcctccactccggcgtcccctcccgcttctccggctccggctccggcaccgactactccctcaccatctccaacctcgagcaggaggacatcgccacctacttctgccagcagggcaacaccctcccctggaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 16000 - RNA, 1089 nt, synthetic construct; identical to SEQ ID NO: 15938
  misc_feature 1..1089: note = derived and/or modified sequence opt2 from Racotumomab_scVH-VH'-VH_chain
  source 1..1089: mol_type = other RNA

SEQ ID NO: 16001 - RNA, 1071 nt, synthetic construct
  misc_feature 1..1071: note = derived and/or modified sequence opt2 from Radretumab_HeavyChain1
  source 1..1071: mol_type = other RNA
gaggtccagctcctcgagtccggcggcggcctcgtccagcccggcggctccctccgcctctcctgcgccgcctccggcttcaccttctcctccttctccatgtcctgggtccgccaggcccccggcaagggcctcgagtgggtctcctccatctccggctcctccggcaccacctactacgccgactccgtcaagggccgcttcaccatctcccgcgacaactccaagaacaccctctacctccagatgaactccctccgcgccgaggacaccgccgtctactactgcgccaagcccttcccctacttcgactactggggccagggcaccctcgtcaccgtctcctccggcgacggctcctccggcggctccggcggcgcctccgagatcgtcctcacccagtcccccggcaccctctccctctcccccggcgagcgcgccaccctctcctgccgcgcctcccagtccgtctcctcctccttcctcgcctggtaccagcagaagcccggccaggccccccgcctcctcatctactacgcctcctcccgcgccaccggcatccccgaccgcttctccggctccggctccggcaccgacttcaccctcaccatctcccgcctcgagcccgaggacttcgccgtctactactgccagcagaccggccgcatcccccccaccttcggccagggcaccaaggtcgagatcaagtccggcggctccggcggcccccgcgccgcccccgaggtctacgccttcgccacccccgagtggcccggctcccgcgacaagcgcaccctcgcctgcctcatccagaacttcatgcccgaggacatctccgtccagtggctccacaacgaggtccagctccccgacgcccgccactccaccacccagccccgcaagaccaagggctccggcttcttcgtcttctcccgcctcgaggtcacccgcgccgagtgggagcagaaggacgagttcatctgccgcgccgtccacgaggccgcctccccctcccagaccgtccagcgcgccgtctccgtcaaccccgagtcctcccgccgcggcggctgc

SEQ ID NO: 16002 - RNA, 414 nt, synthetic construct; identical to SEQ ID NO: 15953
  misc_feature 1..414: note = derived and/or modified sequence opt2 from Radretumab_j_chain
  source 1..414: mol_type = other RNA

SEQ ID NO: 16003 - RNA, 1368 nt, synthetic construct
  misc_feature 1..1368: note = derived and/or modified sequence opt2 from Rafivirumab_HeavyChain1
  source 1..1368: mol_type = other RNA
caggtccagctcgtccagtccggcgccgaggtcaagaagcccggctcctccgtcaaggtctcctgcaaggcctccggcggcaccttcaaccgctacaccgtcaactgggtccgccaggcccccggccagggcctcgagtggatgggcggcatcatccccatcttcggcaccgccaactacgcccagcgcttccagggccgcctcaccatcaccgccgacgagtccacctccaccgcctacatggagctctcctccctccgctccgacgacaccgccgtctacttctgcgcccgcgagaacctcgacaactccggcacctactactacttctccggctggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16004 - RNA, 1368 nt, synthetic construct
  misc_feature 1..1368: note = derived and/or modified sequence opt2 from Rafivirumab_HeavyChain
  source 1..1368: mol_type = other RNA
gaggtccagctcgtccagtccggcgccgaggtcaagaagcccggctcctccgtcaaggtctcctgcaaggcctccggcggcaccttcaaccgctacaccgtcaactgggtccgccaggcccccggccagggcctcgagtggatgggcggcatcatccccatcttcggcaccgccaactacgcccagcgcttccagggccgcctcaccatcaccgccgacgagtccacctccaccgcctacatggagctctcctccctccgctccgacgacaccgccgtctacttctgcgcccgcgagaacctcgacaactccggcacctactactacttctccggctggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16005 - RNA, 654 nt, synthetic construct
  misc_feature 1..654: note = derived and/or modified sequence opt2 from Rafivirumab_LightChain1
  source 1..654: mol_type = other RNA
cagtccgccctcacccagccccgctccgtctccggctcccccggccagtccgtcaccatctcctgcaccggcacctcctccgacatcggcggctacaacttcgtctcctggtaccagcagcaccccggcaaggcccccaagctcatgatctacgacgccaccaagcgcccctccggcgtccccgaccgcttctccggctccaagtccggcaacaccgcctccctcaccatctccggcctccaggccgaggacgaggccgactactactgctgctcctacgccggcgactacacccccggcgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16006 - RNA, 654 nt, synthetic construct
  misc_feature 1..654: note = derived and/or modified sequence opt2 from Rafivirumab_LightChain
  source 1..654: mol_type = other RNA
gagtccgccctcacccagccccgctccgtctccggctcccccggccagtccgtcaccatctcctgcaccggcacctcctccgacatcggcggctacaacttcgtctcctggtaccagcagcaccccggcaaggcccccaagctcatgatctacgacgccaccaagcgcccctccggcgtccccgaccgcttctccggctccaagtccggcaacaccgcctccctcaccatctccggcctccaggccgaggacgaggccgactactactgctgctcctacgccggcgactacacccccggcgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16007 - RNA, 1332 nt, synthetic construct
  misc_feature 1..1332: note = derived and/or modified sequence opt2 from Ralpancizumab_HeavyChain1
  source 1..1332: mol_type = other RNA
caggtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatgggcgagatccacccctccggcggccgcaccaactacaacgagaagttcaagtcccgcgtcaccatgacccgcgacacctccacctccaccgtctacatggagctctcctccctccgctccgaggacaccgccgtctactactgcgcccgcgagcgccccctctacgcctccgacctctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16008 - RNA, 642 nt, synthetic construct
  misc_feature 1..642: note = derived and/or modified sequence opt2 from Ralpancizumab_LightChain1
  source 1..642: mol_type = other RNA
gacatccagatgacccagtccccctcctccctctccgcctccgtcggcgaccgcgtcaccatcacctgcaaggcctcccaggacgtccacaccgccgtcgcctggtaccagcagaagcccggcaaggcccccaagctcctcatctaccacgcctcctaccgctacaccggcgtcccctcccgcttctccggctccggctccggcaccgacttcaccttcaccatctcctccctccagcccgaggacatcgccacctactactgccagcagcgctactccctctggcgcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16009 - RNA, 1338 nt, synthetic construct
  misc_feature 1..1338: note = derived and/or modified sequence opt2 from Ramucirumab_HeavyChain1
  source 1..1338: mol_type = other RNA
gaggtccagctcgtccagtccggcggcggcctcgtcaagcccggcggctccctccgcctctcctgcgccgcctccggcttcaccttctcctcctactccatgaactgggtccgccaggcccccggcaagggcctcgagtgggtctcctccatctcctcctcctcctcctacatctactacgccgactccgtcaagggccgcttcaccatctcccgcgacaacgccaagaactccctctacctccagatgaactccctccgcgccgaggacaccgccgtctactactgcgcccgcgtcaccgacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16010 - RNA, 642 nt, synthetic construct
  misc_feature 1..642: note = derived and/or modified sequence opt2 from Ramucirumab_LightChain1
  source 1..642: mol_type = other RNA
gacatccagatgacccagtccccctcctccgtctccgcctccatcggcgaccgcgtcaccatcacctgccgcgcctcccagggcatcgacaactggctcggctggtaccagcagaagcccggcaaggcccccaagctcctcatctacgacgcctccaacctcgacaccggcgtcccctcccgcttctccggctccggctccggcacctacttcaccctcaccatctcctccctccaggccgaggacttcgccgtctacttctgccagcaggccaaggccttcccccccaccttcggcggcggcaccaaggtcgacatcaagggcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16011 - RNA, 687 nt, synthetic construct
  misc_feature 1..687: note = derived and/or modified sequence opt2 from Ranibiziuab_HeavyChain1
  source 1..687: mol_type = other RNA
gaggtccagctcgtcgagtccggcggcggcctcgtccagcccggcggctccctccgcctctcctgcgccgcctccggctacgacttcacccactacggcaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagaactccctccgcgccgaggacaccgccgtctactactgcgccaagtacccctactactacggcacctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacctc

SEQ ID NO: 16012 - RNA, 642 nt, synthetic construct
  misc_feature 1..642: note = derived and/or modified sequence opt2 from Ranibiziuab_LightChain1
  source 1..642: mol_type = other RNA
gacatccagctcacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16013 - RNA, 639 nt, synthetic construct
  misc_feature 1..639: note = derived and/or modified sequence opt2 from Ranibizumab_fab_fragment
  source 1..639: mol_type = other RNA
gacatccagctcacccagtccccctcctccctctccgcctccgtcggcgaccgcgtcaccatcacctgctccgcctcccaggacatctccaactacctcaactggtaccagcagaagcccggcaaggcccccaaggtcctcatctacttcacctcctccctccactccggcgtcccctcccgcttctccggctccggctccggcaccgacttcaccctcaccatctcctccctccagcccgaggacttcgccacctactactgccagcagtactccaccgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgag

SEQ ID NO: 16014 - RNA, 693 nt, synthetic construct
  misc_feature 1..693: note = derived and/or modified sequence opt2 from Ranibizumab_HeavyChain
  source 1..693: mol_type = other RNA
gaggtccagctcgtcgagtccggcggcggcctcgtccagcccggcggctccctccgcctctcctgcgccgcctccggctacgacttcacccactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccctactactacggcacctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacctc

SEQ ID NO: 16015 - RNA, 654 nt, synthetic construct
  misc_feature 1..654: note = derived and/or modified sequence opt2 from Ranibizumab_LightChain
  source 1..654: mol_type = other RNA
gaggtccagctcgtcgagtccggcggcggcctcgtccagcccggcggctccctccgcctctcctgcgccgcctccggctacgacttcacccactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccctactactacggcacctcccactggtacttcgacgtctggggccagggcaccctcgtcaccgtctcctccgcctccaccaagggcccctccgtcttccccctcgccccctccggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 16016 - RNA, 642 nt, synthetic construct; identical to SEQ ID NO: 16012
  misc_feature 1..642: note = derived and/or modified sequence opt2 from Ranibizumab_LightChain_variant
  source 1..642: mol_type = other RNA

SEQ ID NO: 16017 - RNA, 1368 nt, synthetic construct
  misc_feature 1..1368: note = derived and/or modified sequence opt2 from Refanezumab_HeavyChain1
  source 1..1368: mol_type = other RNA
caggtccagctcgtccagtccggctccgagctcaagaagcccggcgcctccgtcaaggtctcctgcaaggcctccggctacaccttcaccaactacggcatgaactgggtccgccaggcccccggccagggcctcgagtggatgggctggatcaacacctacaccggcgagcccacctacgccgacgacttcaccggccgcttcgtcttctccctcgacacctccgtctccaccgcctacctccagatctcctccctcaaggccgaggacaccgccgtctactactgcgcccgcaaccccatcaactactacggcatcaactacgagggctacgtcatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16018 - RNA, 657 nt, synthetic construct
  misc_feature 1..657: note = derived and/or modified sequence opt2 from Refanezumab_LightChain1
  source 1..657: mol_type = other RNA
gacatcgtcatgacccagtcccccgactccctcgccgtctccctcggcgagcgcgccaccatcaactgcaagtcctcccactccgtcctctactcctccaaccagaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccaccagtacctctcctccctcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16019 - RNA, 1314 nt, synthetic construct
  misc_feature 1..1314: note = derived and/or modified sequence opt2 from REGN2810_HeavyChain1
  source 1..1314: mol_type = other RNA
gaggtccagctcctcgagtccggcggcgtcctcgtccagcccggcggctccctccgcctctcctgcgccgcctccggcttcaccttctccaacttcggcacctgggtccgccaggcccccggcaagggcctcgagtgggtctccggcatctccggcggcggccgcgacacctacttcgccgactccgtcaagggccgcttcaccatctcccgcgacaactccaagaacaccctctacctccagaactccctcaagggcgaggacaccgccgtctactactgcgtcaagtggggcaacatctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtccacgaggccctccacaaccactacacccagaagtccctctccctctccctcggc

SEQ ID NO: 16020 - RNA, 639 nt, synthetic construct
  misc_feature 1..639: note = derived and/or modified sequence opt2 from REGN2810_LightChain1
  source 1..639: mol_type = other RNA
gacatccagacccagtccccctcctccctctccgcctccgtcggcgactccatcaccatcacctgccgcgcctccctctccatcaacaccttcctcaactggtaccagcagaagcccggcaaggcccccaacctcctcatctacgccgcctcctccctccacggcggcgtcccctcccgcttctccggctccggctccggcaccgacttcaccctcaccatccgcaccctccagcccgaggacttcgccacctactactgccagcagtcctccaacacccccttcaccttcggccccggcaccgtcgtcgacttccgccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16021 - RNA, 651 nt, synthetic construct
  misc_feature 1..651: note = derived and/or modified sequence opt2 from rhuMab_HER2(9CI)_LightChain
  source 1..651: mol_type = other RNA
gtccactccgacatccagatgacccagtccccctcctccctctccgcctccgtcggcgaccgcgtcaccatcacctgcaaggcctcccaggacgtctccatcggcgtcgcctggtaccagcagaagcccggcaaggcccccaagctcctcatctactccgcctcctaccgctacaccggcgtcccctcccgcttctccggctccggctccggcaccgacttcaccctcaccatctcctccctccagcccgaggacttcgccacctactactgccagcagtactacatctacccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16022 - RNA, 1215 nt, synthetic construct
  misc_feature 1..1215: note = derived and/or modified sequence opt2 from rhuMab_HER2_HeavyChain
  source 1..1215: mol_type = other RNA
gaggtccagctcgtcgagtccggcggcggcctcgtccagcccggcggctccctccgcctctcctgcgccgcctccggcttcaccttcaccgactacaccatggactgggtccgccaggcccccggcaagggcctcaccgccgtctactactgcgcccgcaacctcggcccctccttctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggccccaag

SEQ ID NO: 16023 - RNA, 645 nt, synthetic construct
  misc_feature 1..645: note = derived and/or modified sequence opt2 from rhuMab_HER2_LightChain
  source 1..645: mol_type = other RNA
tccgacatccagatgacccagtccccctcctccctctccgcctccgtcggcgaccgcgtcaccatcacctgccgcgcctcccaggacgtcaacaccgccgtcgcctggtaccagcagaagcccggcaaggcccccaagctcctcatctactccgcctccttcctctactccggcgtcccctcccgcttctccggctcccgctccggcaccgacttcaccctcaccatctcctccctccagcccgaggacttcgccacctactactgccagcagcactacaccaccccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16024 - RNA, 318 nt, synthetic construct
  misc_feature 1..318: note = derived and/or modified sequence opt2 from rhuMab_HER2_LightChain_variant1
  source 1..318: mol_type = other RNA
accgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16025 - RNA, 642 nt, synthetic construct
  misc_feature 1..642: note = derived and/or modified sequence opt2 from rhuMab_HER2_LightChain_variant2
  source 1..642: mol_type = other RNA
gacatccagatgacccagtccccctcctccctctccgcctccgtcggcgaccgcgtcaccatcacctgccgcgcctcccaggacgtcaacaccgccgtcgcctggtaccagcagaagcccggcaaggcccccaagctcctcatctactccgcctccttcctctactccggcgtcccctcccgcttctccggctcccgctccggcaccgacttcaccctcaccatctcctccctccagcccgaggacttcgccacctactactgccagcagcactacaccaccccccccaccttcggccagggcaccaaggtcgagatcaagcgcacctgcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16026 - RNA, 642 nt, synthetic construct
  misc_feature 1..642: note = derived and/or modified sequence opt2 from rhuMab_HER2_LightChain_variant3
  source 1..642: mol_type = other RNA
gacatccagatgacccagtccccctcctccctctccgcctccgtcggcgaccgcgtcaccatcacctgccgcgcctcccaggacgtcaacaccgccgtcgcctggtaccagcagaagcccggcaaggcccccaagctcctcatctactccgcctccttcctctactccggcgtcccctcccgcttctccggctcccgctccggcaccgacttcaccctcaccatctcctccctccagcccgaggacttcgccacctactactgccagcagcactacaccaccccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16027 - RNA, 645 nt, synthetic construct; identical to SEQ ID NO: 16023
  misc_feature 1..645: note = derived and/or modified sequence opt2 from rhuMab_HER2_LightChain_variant4
  source 1..645: mol_type = other RNA

SEQ ID NO: 16028 - RNA, 321 nt, synthetic construct
  misc_feature 1..321: note = derived and/or modified sequence opt2 from rhuMab_HER2_LightChain_V-Region
  source 1..321: mol_type = other RNA
gacatccagatgacccagtccccctcctccctctccgcctccgtcggcgaccgcgtcaccatcacctgccgcgcctcccaggacgtcaacaccgccgtcgcctggtaccagcagaagcccggcaaggcccccaagctcctcatctactccgcctccttcctctactccggcgtcccctcccgcttctccggctcccgctccggcaccgacttcaccctcaccatctcctccctccagcccgaggacttcgccacctactactgccagcagcactacaccaccccccccaccttcggccagggcaccaaggtcgagatcaag

SEQ ID NO: 16029 - RNA, 1350 nt, synthetic construct
  misc_feature 1..1350: note = derived and/or modified sequence opt2 from rhuMab_HER2_gamma1-Chain
  source 1..1350: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16030 - RNA, 1350 nt, synthetic construct
  misc_feature 1..1350: note = derived and/or modified sequence opt2 from rhuMab_HER2__gamma1-Chain
  source 1..1350: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctcctgctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16031 - RNA, 729 nt, synthetic construct
  misc_feature 1..729: note = derived and/or modified sequence opt2 from rhuMab_HER2_gamma1-Chain__rhuMab_HER2_LightChain_sc4D5
  source 1..729: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccggcggcggcggctccggcggcggcggctccggcggcggcggctccgacatccagatgacccagtccccctcctccctctccgcctccgtcggcgaccgcgtcaccatcacctgccgcgcctcccaggacgtcaacaccgccgtcgcctggtaccagcagaagcccggcaaggcccccaagctcctcatctactccgcctccttcctctactccggcgtcccctcccgcttctccggctcccgctccggcaccgacttcaccctcaccatctcctccctccagcccgaggacttcgccacctactactgccagcagcactacaccaccccccccaccttcggccagggcaccaaggtcgagatcaagcgc

SEQ ID NO: 16032 - RNA, 1350 nt, synthetic construct; identical to SEQ ID NO: 16029
  misc_feature 1..1350: note = derived and/or modified sequence opt2 from rhuMab_HER2_gamma1-Chain_variant1
  source 1..1350: mol_type = other RNA

SEQ ID NO: 16033 - RNA, 1350 nt, synthetic construct; identical to SEQ ID NO: 16030
  misc_feature 1..1350: note = derived and/or modified sequence opt2 from rhuMab_HER2_gamma1-Chain_variant2
  source 1..1350: mol_type = other RNA

SEQ ID NO: 16034 - RNA, 1350 nt, synthetic construct
  misc_feature 1..1350: note = derived and/or modified sequence opt2 from rhuMab_HER2_gamma1-Chain_variant3
  source 1..1350: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgctgcgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16035 - RNA, 360 nt, synthetic construct
  misc_feature 1..360: note = derived and/or modified sequence opt2 from rhuMab_HER2_gamma1-Chain_V-Region
  source 1..360: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctcc

SEQ ID NO: 16036 - RNA, 1359 nt, synthetic construct; identical to SEQ ID NO: 15367
  misc_feature 1..1359: note = derived and/or modified sequence opt2 from rhuMAb-VEGF_HeavyChain1
  source 1..1359: mol_type = other RNA

SEQ ID NO: 16037 - RNA, 642 nt, synthetic construct; identical to SEQ ID NO: 15368
  misc_feature 1..642: note = derived and/or modified sequence opt2 from rhuMAb-VEGF_LightChain1
  source 1..642: mol_type = other RNA

SEQ ID NO: 16038 - RNA, 642 nt, synthetic construct; identical to SEQ ID NO: 15368
  misc_feature 1..642: note = derived and/or modified sequence opt2 from rhuMAb-VEGF_LightChain
  source 1..642: mol_type = other RNA

SEQ ID NO: 16039 - RNA, 321 nt, synthetic construct; identical to SEQ ID NO: 15377
  misc_feature 1..321: note = derived and/or modified sequence opt2 from rhuMAb-VEGF_LightChain__VG-Region
  source 1..321: mol_type = other RNA

SEQ ID NO: 16040 - RNA, 1359 nt, synthetic construct; identical to SEQ ID NO: 15367
  misc_feature 1..1359: note = derived and/or modified sequence opt2 from rhuMAb-VEGF_gamma1-Chain
  source 1..1359: mol_type = other RNA

SEQ ID NO: 16041 - RNA, 369 nt, synthetic construct; identical to SEQ ID NO: 15372
  misc_feature 1..369: note = derived and/or modified sequence opt2 from rhuMAb-VEGF_gamma1-Chain_VDG-Region
  source 1..369: mol_type = other RNA

SEQ ID NO: 16042 - RNA, 1338 nt, synthetic construct
  misc_feature 1..1338: note = derived and/or modified sequence opt2 from Rilotumumab_HeavyChain1
  source 1..1338: mol_type = other RNA
caggtccagctccaggagtccggccccggcctcgtcaagccctccgagaccctctccctcacctgcaccgtctccggcggctccatctccatctactactggtcctggatccgccagccccccggcaagggcctcgagtggatcggctacgtctactactccggctccaccaactacaacccctccctcaagtcccgcgtcaccatctccgtcgacacctccaagaaccagttctccctcaagctcaactccgtcaccgccgccgacaccgccgtctactactgcgcccgcggcggctacgacttctggtccggctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16043 - RNA, 645 nt, synthetic construct
  misc_feature 1..645: note = derived and/or modified sequence opt2 from Rilotumumab_LightChain1
  source 1..645: mol_type = other RNA
gagatcgtcatgacccagtcccccgccaccctctccgtctcccccggcgagcgcgccaccctctcctgccgcgcctcccagtccgtcgactccaacctcgcctggtaccgccagaagcccggccaggccccccgcctcctcatctacggcgcctccacccgcgccaccggcatccccgcccgcttctccggctccggctccggcaccgagttcaccctcaccatctcctccctccagtccgaggacttcgccgtctactactgccagcagtacatcaactggccccccatcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16044 - RNA, 1071 nt, synthetic construct; identical to SEQ ID NO: 16001
  misc_feature 1..1071: note = derived and/or modified sequence opt2 from Rilotumumab_scFv-CH_chain
  source 1..1071: mol_type = other RNA

SEQ ID NO: 16045 - RNA, 1347 nt, synthetic construct
  misc_feature 1..1347: note = derived and/or modified sequence opt2 from Rinucumab_HeavyChain1
  source 1..1347: mol_type = other RNA
cagctccagctccaggagtccggccccggcctcgtcaagccctccgagaccctctccctcacctgcaccgtctccggcggctccatcacctcctcctcctactactggggctggatccgccagccccccggcaagggcctcgagtggatcggctccatctactaccgcggctccaccaactacaacccctccctcaagtcccgcgtcaccatctccgtcgactcctccaagaaccagttctacctcaaggtctcctccgtcaccgccgtcgacaccgccgtctactactgcgcccgccagaacggcgccgcccgcccctcctggttcgacccctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16046 - RNA, 1344 nt, synthetic construct
  misc_feature 1..1344: note = derived and/or modified sequence opt2 from Rinucumab_HeavyChain
  source 1..1344: mol_type = other RNA
cagctccagctccaggagtccggccccggcctcgtcaagccctccgagaccctctccctcacctgcaccgtctccggcggctccatcacctcctcctcctactactggggctggatccgccagccccccggcaagggcctcgagtggatcggctccatctactaccgcggctccaccaactacaacccctccctcaagtcccgcgtcaccatctccgtcgactcctccaagaaccagttctacctcaaggtctcctccgtcaccgccgtcgacaccgccgtctactactgcgcccgccagaacggcgccgcccgcccctcctggttcgacccctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 16047 - RNA, 645 nt, synthetic construct
  misc_feature 1..645: note = derived and/or modified sequence opt2 from Rinucumab_LightChain1
  source 1..645: mol_type = other RNA
gagatcgtcctcacccagtcccccgacaccatctccctctcccccggcgagcgcgccaccctctcctgccgcgcctcccagtccatctcctccatctacctcgcctggtaccagcagaagcccggccaggccccccgcctcctcatctacggcgcctcctcccgcgtcaccggcatccccgaccgcttctccgtctccggctccggcaccgacttcaccctcaccatctcccgcctcgagcccgaggacttcgccgtctactactgccagcactacggcatctcccccttcaccttcggccccggcaccaaggtcgacatccgccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16048 - RNA, 1347 nt, synthetic construct
  misc_feature 1..1347: note = derived and/or modified sequence opt2 from Risankizumab_HeavyChain1
  source 1..1347: mol_type = other RNA
caggtccagctcgtccagtccggcgccgaggtcaagaagcccggctcctccgtcaaggtctcctgcaaggcctccggctacaccttcaccgaccagaccatccactggatgcgccaggcccccggccagggcctcgagtggatcggctacatctacccccgcgacgactcccccaagtacaacgagaacttcaagggcaaggtcaccatcaccgccgacaagtccacctccaccgcctacatggagctctcctccctccgctccgaggacaccgccgtctactactgcgccatccccgaccgctccggctacgcctggttcatctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16049 - RNA, 642 nt, synthetic construct
  misc_feature 1..642: note = derived and/or modified sequence opt2 from Risankizumab_LightChain1
  source 1..642: mol_type = other RNA
gacatccagatgacccagtccccctcctccctctccgcctccgtcggcgaccgcgtcaccatcacctgcaaggcctcccgcgacgtcgccatcgccgtcgcctggtaccagcagaagcccggcaaggtccccaagctcctcatctactgggcctccacccgccacaccggcgtcccctcccgcttctccggctccggctcccgcaccgacttcaccctcaccatctcctccctccagcccgaggacgtcgccgactacttctgccaccagtactcctcctaccccttcaccttcggctccggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16050 - RNA, 1353 nt, synthetic construct
  misc_feature 1..1353: note = derived and/or modified sequence opt2 from Rituximab_HeavyChain
  source 1..1353: mol_type = other RNA
caggtccagctccagcagcccggcgccgagctcgtcaagcccggcgcctccgtcaagatgtcctgcaaggcctccggctacaccttcacctcctacaacatgcactgggtcaagcagacccccggccgcggcctcgagtggatcggcgccatctaccccggcaacggcgacacctcctacaaccagaagttcaagggcaaggccaccctcaccgccgacaagtcctcctccaccgcctacatgcagctctcctccctcacctccgaggactccgccgtctactactgcgcccgctccacctactacggcggcgactggtacttcaacgtctggggcgccggcaccaccgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16051 - RNA, 1353 nt, synthetic construct
  misc_feature 1..1353: note = derived and/or modified sequence opt2 from Rituximab_HeavyChain_variant
  source 1..1353: mol_type = other RNA
caggtccagctccagcagcccggcgccgagctcgtcaagcccggcgcctccgtcaagatgtcctgcaaggcctccggctacaccttcacctcctacaacatgcactgggtcaagcagacccccggccgcggcctcgagtggatcggcgccatctaccccggcaacggcgacacctcctacaaccagaagttcaagggcaaggccaccctcaccgccgacaagtcctcctccaccgcctacatgcagctctcctccctcacctccgaggactccgccgtctactactgcgcccgctccacctactacggcggcgactggtacttcaacgtctggggcgccggcaccaccgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16052 - RNA, 639 nt, synthetic construct
  misc_feature 1..639: note = derived and/or modified sequence opt2 from Rituximab_LightChain
  source 1..639: mol_type = other RNA
cagatcgtcctctcccagtcccccgccatcctctccgcctcccccggcgagaaggtcaccatgacctgccgcgcctcctcctccgtctcctacatccactggttccagcagaagcccggctcctcccccaagccctggatctacgccacctccaacctcgcctccggcgtccccgtccgcttctccggctccggctccggcacctcctactccctcaccatctcccgcgtcgaggccgaggacgccgccacctactactgccagcagtggacctccaacccccccaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16053 - RNA, 714 nt, synthetic construct
  misc_feature 1..714: note = derived and/or modified sequence opt2 from Rivabazumab_pegol_HeavyChain1
  source 1..714: mol_type = other RNA
gaggtccagctcgtcgagtccggcggcggcgtcgtccagcccggccgctccctccgcctctcctgcgccgcctccggcttcaccttctccaactaccccatgcactgggtccgccaggcccccggcaagggcctcgagtgggtcgccgtcatctcctacgacggctccgagaagtggtacgccgactccgtcaagggccgcttcaccatctcccgcgacaactccaagaacaccctctacctcgagatgaactccctccgccccgaggacaccgccgtctactactgcgcccgcaaccgcggcgacatctactacgacttcacctacgccatggacatctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctccgacaagacccacacctgccccccctgccccgcc

SEQ ID NO: 16054 - RNA, 642 nt, synthetic construct
  misc_feature 1..642: note = derived and/or modified sequence opt2 from Rivabazumab_pegol_LightChain1
  source 1..642: mol_type = other RNA
gacatccagctcacccagtccccctccaccctctccgcctccgtcggcgactccgtcaccatcacctgccgcgcctccgagggcgtcgaccgctggctcgcctggtaccagcagaagcccggccgcgcccccaagctcctcatctacgacgcctccaccctccagtccggcgtcccctcccgcttctccggctccggctccggcaccgagttctccctcaccatctcctccctccagcccgacgacgtcgccacctactactgccagcacttctggggcaccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtcc

SEQ ID NO: 16055 - RNA, 1344 nt, synthetic construct
  misc_feature 1..1344: note = derived and/or modified sequence opt2 from Robatumumab_HeavyChain1
  source 1..1344: mol_type = other RNA
gaggtccagctcgtccagtccggcggcggcctcgtcaagcccggcggctccctccgcctctcctgcgccgcctccggcttcaccttctcctccttcgccatgcactgggtccgccaggcccccggcaagggcctcgagtggatctccgtcatcgacacccgcggcgccacctactacgccgactccgtcaagggccgcttcaccatctcccgcgacaacgccaagaactccctctacctccagatgaactccctccgcgccgaggacaccgccgtctactactgcgcccgcctcggcaacttctactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16056 - RNA, 642 nt, synthetic construct
  misc_feature 1..642: note = derived and/or modified sequence opt2 from Robatumumab_LightChain1
  source 1..642: mol_type = other RNA
gagatcgtcctcacccagtcccccggcaccctctccgtctcccccggcgagcgcgccaccctctcctgccgcgcctcccagtccatcggctcctccctccactggtaccagcagaagcccggccaggccccccgcctcctcatcaagtacgcctcccagtccctctccggcatccccgaccgcttctccggctccggctccggcaccgacttcaccctcaccatctcccgcctcgagcccgaggacttcgccgtctactactgccaccagtcctcccgcctcccccacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16057 - RNA, 1368 nt, synthetic construct
  misc_feature 1..1368: note = derived and/or modified sequence opt2 from Roledumab_HeavyChain1
  source 1..1368: mol_type = other RNA
caggtccagctcgtcgagtccggcggcggcgtcgtccagcccggccgctccctccgcctctcctgcaccgcctccggcttcaccttcaagaactacgccatgcactgggtccgccaggcccccgccaagggcctcgagtgggtcgccaccatctcctacgacggccgcaacatccagtacgccgactccgtcaagggccgcttcaccttctcccgcgacaactcccaggacaccctctacctccagctcaactccctccgccccgaggacaccgccgtctactactgcgcccgccccgtccgctcccgctggctccagctcggcctcgaggacgccttccacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16058 - RNA, 642 nt, synthetic construct
  misc_feature 1..642: note = derived and/or modified sequence opt2 from Roledumab_LightChain1
  source 1..642: mol_type = other RNA
gccatccgcatgacccagtccccctcctccttctccgcctccaccggcgaccgcgtcaccatcacctgccgcgcctcccaggacatccgcaactacgtcgcctggtaccagcagaagtccggcaaggcccccaagttcctcatctacgccgcctccaccctccagtccggcgtcccctcccgcttctccggctccggctccggcaccgacttcaccctcaccatcaactccctccagtccgaggacttcgccacctactactgccagcagtactacaactccccccccaccttcggccagggcacccgcgtcgagatcacccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16059 - RNA, 639 nt, synthetic construct; identical to SEQ ID NO: 16013
  misc_feature 1..639: note = derived and/or modified sequence opt2 from Romosozumab_fab_fragment
  source 1..639: mol_type = other RNA

SEQ ID NO: 16060 - RNA, 1347 nt, synthetic construct
  misc_feature 1..1347: note = derived and/or modified sequence opt2 from Romosozumab_HeavyChain1
  source 1..1347: mol_type = other RNA
gaggtccagctcgtccagtccggcgccgaggtcaagaagcccggcgcctccgtcaaggtctcctgcaaggcctccggctacaccttcaccgactacaacatgcactgggtccgccaggcccccggccagggcctcgagtggatgggcgagatcaaccccaactccggcggcgccggctacaaccagaagttcaagggccgcgtcaccatgaccaccgacacctccacctccaccgcctacatggagctccgctccctccgctccgacgacaccgccgtctactactgcgcccgcctcggctacgacgacatctacgacgactggtacttcgacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16061 - RNA, 642 nt, synthetic construct
  misc_feature 1..642: note = derived and/or modified sequence opt2 from Romosozumab_LightChain1
  source 1..642: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctcctctccggcgtcccctcccgcttctccggctccggctccggcaccgacttcaccctcaccatctcctccctccagcccgaggacttcgccacctactactgccagcagggcgacaccctcccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16062 - RNA, 1326 nt, synthetic construct
  misc_feature 1..1326: note = derived and/or modified sequence opt2 from Rontalizuab_HeavyChain1
  source 1..1326: mol_type = other RNA
gaggtccagctcgtcgagtccggcggcggcctcgtccagcccggcggctccctccgcctctcctgcgccacctccggctacaccttcaccgagtacatcatccactgggtccgccaggcccccggcaagggcctcgagtgggtcgcctccatcaaccccgactacgacatcaccaactacaaccagcgcttcaagggccgcttcaccatctccctcgacaagtccaagcgcaccgcctacctccagaactccctccgcgccgaggacaccgccgtctactactgcgcctcctggatctccgacttcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 16063 - RNA, 648 nt, synthetic construct
  misc_feature 1..648: note = derived and/or modified sequence opt2 from Rontalizuab_LightChain1
  source 1..648: mol_type = other RNA
gacatccagacccagtccccctcctccctctccgcctccgtcggcgaccgcgtcaccatcacctgccgcgcctcccagtccgtctccacctcctcctactcctaccactggtaccagcagaagcccggcaaggcccccaaggtcctcatctcctacgcctccaacctcgagtccggcgtcccctcccgcttctccggctccggctccggcaccgacttcaccctcaccatctcctccctccagcccgaggacttcgccacctactactgccagcactcctggggcatcccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16064 - RNA, 1341 nt, synthetic construct
  misc_feature 1..1341: note = derived and/or modified sequence opt2 from Rontalizumab_HeavyChain1
  source 1..1341: mol_type = other RNA
gaggtccagctcgtcgagtccggcggcggcctcgtccagcccggcggctccctccgcctctcctgcgccacctccggctacaccttcaccgagtacatcatccactgggtccgccaggcccccggcaagggcctcgagtgggtcgcctccatcaaccccgactacgacatcaccaactacaaccagcgcttcaagggccgcttcaccatctccctcgacaagtccaagcgcaccgcctacctccagatgaactccctccgcgccgaggacaccgccgtctactactgcgcctcctggatctccgacttcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16065 - RNA, 654 nt, synthetic construct
  misc_feature 1..654: note = derived and/or modified sequence opt2 from Rontalizumab_LightChain1
  source 1..654: mol_type = other RNA
gacatccagatgacccagtccccctcctccctctccgcctccgtcggcgaccgcgtcaccatcacctgccgcgcctcccagtccgtctccacctcctcctactcctacatgcactggtaccagcagaagcccggcaaggcccccaaggtcctcatctcctacgcctccaacctcgagtccggcgtcccctcccgcttctccggctccggctccggcaccgacttcaccctcaccatctcctccctccagcccgaggacttcgccacctactactgccagcactcctggggcatcccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16066 - RNA, 1341 nt, synthetic construct
  misc_feature 1..1341: note = derived and/or modified sequence opt2 from Rovalpituzumab_tesirine_HeavyChain1
  source 1..1341: mol_type = other RNA
caggtccagctcgtccagtccggcgccgaggtcaagaagcccggcgcctccgtcaaggtctcctgcaaggcctccggctacaccttcaccaactacggcatgaactgggtccgccaggcccccggccagggcctcgagtggatgggctggatcaacacctacaccggcgagcccacctacgccgacgacttcaagggccgcgtcaccatgaccaccgacacctccacctccaccgcctacatggagctccgctccctccgctccgacgacaccgccgtctactactgcgcccgcatcggcgactcctccccctccgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16067 - RNA, 642 nt, synthetic construct
  misc_feature 1..642: note = derived and/or modified sequence opt2 from Rovalpituzumab_tesirine_LightChain1
  source 1..642: mol_type = other RNA
gagatcgtcatgacccagtcccccgccaccctctccgtctcccccggcgagcgcgccaccctctcctgcaaggcctcccagtccgtctccaacgacgtcgtctggtaccagcagaagcccggccaggccccccgcctcctcatctactacgcctccaaccgctacaccggcatccccgcccgcttctccggctccggctccggcaccgagttcaccctcaccatctcctccctccagtccgaggacttcgccgtctactactgccagcaggactacacctccccctggaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16068 - RNA, 1341 nt, synthetic construct
  misc_feature 1..1341: note = derived and/or modified sequence opt2 from Rovelizumab_HeavyChain1
  source 1..1341: mol_type = other RNA
caggtccagctcgtccagtccggcgccgaggtcaagaagcccggcgcctccgtcaaggtctcctgcaaggcctccggctacaccttcaccaacaactggatgcagtgggtccgccaggcccccggccagggcctcgagtggatgggcgccatcttccccggcgacgacgagacccgctacacccagaagttccgcggcaaggccaccatcaccgccgacacctccacctccaccgcctacatggagctctcctccctccgctccgaggacaccgccgtctactactgcggccgcggcggcaagctccgccccttcgccctcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16069 - RNA, 654 nt, synthetic construct
  misc_feature 1..654: note = derived and/or modified sequence opt2 from Rovelizumab_LightChain1
  source 1..654: mol_type = other RNA
gacatccagatgacccagtccccctcctccctctccgcctccgtcggcgaccgcgtcaccatcacctgccgcgcctccgagtccgtcgagtcctacggcaacaacttcatgtactggtaccagcagaagcccggcaaggcccccaagctcctcatctacctcgcctccaacctcgagtccggcgtcccctcccgcttctccggctccggctccggcaccgacttcaccctcaccatctcctccctccagcccgaggacttcgccacctactactgccaccaggacaacgaggacccccccaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16070 - RNA, 1341 nt, synthetic construct
  misc_feature 1..1341: note = derived and/or modified sequence opt2 from Ruplizumab_HeavyChain1
  source 1..1341: mol_type = other RNA
caggtccagctcgtccagtccggcgccgaggtcgtcaagcccggcgcctccgtcaagctctcctgcaaggcctccggctacatcttcacctcctactacatgtactgggtcaagcaggcccccggccagggcctcgagtggatcggcgagatcaacccctccaacggcgacaccaacttcaacgagaagttcaagtccaaggccaccctcaccgtcgacaagtccgcctccaccgcctacatggagctctcctccctccgctccgaggacaccgccgtctactactgcacccgctccgacggccgcaacgacatggactcctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16071 - RNA, 654 nt, synthetic construct
  misc_feature 1..654: note = derived and/or modified sequence opt2 from Ruplizumab_LightChain1
  source 1..654: mol_type = other RNA
gacatcgtcctcacccagtcccccgccaccctctccgtctcccccggcgagcgcgccaccatctcctgccgcgcctcccagcgcgtctcctcctccacctactcctacatgcactggtaccagcagaagcccggccagccccccaagctcctcatcaagtacgcctccaacctcgagtccggcgtccccgcccgcttctccggctccggctccggcaccgacttcaccctcaccatctcctccgtcgagcccgaggacttcgccacctactactgccagcactcctgggagatcccccccaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16072 - RNA, 1353 nt, synthetic construct
  misc_feature 1..1353: note = derived and/or modified sequence opt2 from Sacituzumab_govitecan_HeavyChain1
  source 1..1353: mol_type = other RNA
caggtccagctccagcagtccggctccgagctcaagaagcccggcgcctccgtcaaggtctcctgcaaggcctccggctacaccttcaccaactacggcatgaactgggtcaagcaggcccccggccagggcctcaagtggatgggctggatcaacacctacaccggcgagcccacctacaccgacgacttcaagggccgcttcgccttctccctcgacacctccgtctccaccgcctacctccagatctcctccctcaaggccgacgacaccgccgtctacttctgcgcccgcggcggcttcggctcctcctactggtacttcgacgtctggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16073 - RNA, 642 nt, synthetic construct
  misc_feature 1..642: note = derived and/or modified sequence opt2 from Sacituzumab_govitecan_LightChain1
  source 1..642: mol_type = other RNA
gacatccagctcacccagtccccctcctccctctccgcctccgtcggcgaccgcgtctccatcacctgcaaggcctcccaggacgtctccatcgccgtcgcctggtaccagcagaagcccggcaaggcccccaagctcctcatctactccgcctcctaccgctacaccggcgtccccgaccgcttctccggctccggctccggcaccgacttcaccctcaccatctcctccctccagcccgaggacttcgccgtctactactgccagcagcactacatcacccccctcaccttcggcgccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16074 - RNA, 1326 nt, synthetic construct
  misc_feature 1..1326: note = derived and/or modified sequence opt2 from Samalizumab_HeavyChain1
  source 1..1326: mol_type = other RNA
caggtccagctccagcagtccggctccgagctcaagaagcccggcgcctccgtcaagatctcctgcaaggcctccggctactccttcaccgactacatcatcctctgggtccgccagaaccccggcaagggcctcgagtggatcggccacatcgacccctactacggctcctccaactacaacctcaagttcaagggccgcgtcaccatcaccgccgaccagtccaccaccaccgcctacatggagctctcctccctccgctccgaggacaccgccgtctactactgcggccgctccaagcgcgactacttcgactactggggccagggcaccaccctcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 16075 - RNA, 642 nt, synthetic construct
  misc_feature 1..642: note = derived and/or modified sequence opt2 from Samalizumab_LightChain1
  source 1..642: mol_type = other RNA
gacatccagatgacccagtccccctcctccctctccgcctccatcggcgaccgcgtcaccatcacctgcaaggcctcccaggacatcaactcctacctctcctggttccagcagaagcccggcaaggcccccaagctcctcatctaccgcgccaaccgcctcgtcgacggcgtcccctcccgcttctccggctccggctccggcaccgactacaccctcaccatctcctccctccagcccgaggacttcgccgtctactactgcctccagtacgacgagttcccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16076 - RNA, 1338 nt, synthetic construct
  misc_feature 1..1338: note = derived and/or modified sequence opt2 from Sarilumab_HeavyChain1
  source 1..1338: mol_type = other RNA
gaggtccagctcgtcgagtccggcggcggcctcgtccagcccggccgctccctccgcctctcctgcgccgcctcccgcttcaccttcgacgactacgccatgcactgggtccgccaggcccccggcaagggcctcgagtgggtctccggcatctcctggaactccggccgcatcggctacgccgactccgtcaagggccgcttcaccatctcccgcgacaacgccgagaactccctcttcctccagatgaacggcctccgcgccgaggacaccgccctctactactgcgccaagggccgcgactccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16077 - RNA, 642 nt, synthetic construct
  misc_feature 1..642: note = derived and/or modified sequence opt2 from Sarilumab_LightChain1
  source 1..642: mol_type = other RNA
gacatccagatgacccagtccccctcctccgtctccgcctccgtcggcgaccgcgtcaccatcacctgccgcgcctcccagggcatctcctcctggctcgcctggtaccagcagaagcccggcaaggcccccaagctcctcatctacggcgcctcctccctcgagtccggcgtcccctcccgcttctccggctccggctccggcaccgacttcaccctcaccatctcctccctccagcccgaggacttcgcctcctactactgccagcaggccaactccttcccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16078 - RNA, 1296 nt, synthetic construct
  misc_feature 1..1296: note = derived and/or modified sequence opt2 from Satumomab_pendetide_HeavyChain
  source 1..1296: mol_type = other RNA
caggtccagctccagcagtccgacgccgagctcgtcaagcccggcgcctccgtcaagatctcctgcaaggcctccggctacaccttcaccgaccacgccatccactgggccaagcagaagcccgagcagggcctcgagtggatcggctacatctcccccggcaacgacgacatcaagtacaacgagaagttcaagggcaaggccaccctcaccgccgacaagtcctcctccaccgcctacatgcagctcaactccctcacctccgaggactccgccgtctacttctgcaagcgctcctactacggccactggggccagggcaccaccctcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtctgccccccctgcaagtgccccgcccccaacctcctcggcggcccctccgtcttcatcttcccccccaagatcaaggacgtcctcatgatctccctctcccccatcgtcacctgcgtcgtcgtcgacgtctccgaggacgaccccgacgtccagatctcctggttcgtcaacaacgtcgaggtccacaccgcccagacccagacccaccgcgaggactacaactccaccctccgcgtcgtctccgccctccccatccagcaccaggactggatgtccggcaaggagttcaagtgcaaggtcaacaacaaggacctccccgcccccatcgagcgcaccatctccaagcccaagggctccgtccgcgccccccaggtctacgtcctccccccccccgaggaggagatgaccaagaagcaggtcaccctcacctgcatggtcaccgacttcatgcccgaggacatctacgtcgagtggaccaacaacggcaagaccgagctcaactacaagaacaccgagcccgtcctcgactccgacggctcctacttcatgtactccaagctccgcgtcgagaagaagaactgggtcgagcgcaactcctactcctgctccgtcgtccacgagggcctccacaaccaccacaccaccaagtccttctcccgc

SEQ ID NO: 16079 - RNA, 630 nt, synthetic construct
  misc_feature 1..630: note = derived and/or modified sequence opt2 from Satumomab_pendetide_LightChain
  source 1..630: mol_type = other RNA
gacatccagatgacccagtcccccgcctccctctccgtctccgtcggcgagaccgtcaccatcacctgccgcgcctccgagaacatctactccaacctcgcctggtaccagcagaagcagggcaagtccccccagctcctcgtctacgccgccaccaacctcgccgacggcgtcccctcccgcttctccggctccggctccggcacccagtactccctcaagatcaactccctccagtccgaggacttcggctcctactactgccagcacttctggggcaccccctacaccttcggcggcggcacccgcctcgagatcaagcgcgccgacgccgcccccaccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaac

SEQ ID NO: 16080 - RNA, 1371 nt, synthetic construct
  misc_feature 1..1371: note = derived and/or modified sequence opt2 from Secukinumab_HeavyChain1
  source 1..1371: mol_type = other RNA
gaggtccagctcgtcgagtccggcggcggcctcgtccagcccggcggctccctccgcctctcctgcgccgcctccggcttcaccttctccaactactggatgaactgggtccgccaggcccccggcaagggcctcgagtgggtcgccgccatcaaccaggacggctccgagaagtactacgtcggctccgtcaagggccgcttcaccatctcccgcgacaacgccaagaactccctctacctccagatgaactccctccgcgtcgaggacaccgccgtctactactgcgtccgcgactactacgacatcctcaccgactactacatccactactggtacttcgacctctggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16081 - RNA, 645 nt, synthetic construct
  misc_feature 1..645: note = derived and/or modified sequence opt2 from Secukinumab_LightChain1
  source 1..645: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccctgcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16082 - RNA, 1335 nt, synthetic construct
  misc_feature 1..1335: note = derived and/or modified sequence opt2 from Seribantumab_HeavyChain1
  source 1..1335: mol_type = other RNA
gaggtccagctcctcgagtccggcggcggcctcgtccagcccggcggctccctccgcctctcctgcgccgcctccggcttcaccttctcccactacgtcatggcctgggtccgccaggcccccggcaagggcctcgagtgggtctcctccatctcctcctccggcggctggaccctctacgccgactccgtcaagggccgcttcaccatctcccgcgacaactccaagaacaccctctacctccagatgaactccctccgcgccgaggacaccgccgtctactactgcacccgcggcctcaagatggccaccatcttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16083 - RNA, 651 nt, synthetic construct
  misc_feature 1..651: note = derived and/or modified sequence opt2 from Seribantumab_LightChain1
  source 1..651: mol_type = other RNA
cagtccgccctcacccagcccgcctccgtctccggctcccccggccagtccatcaccatctcctgcaccggcacctcctccgacgtcggctcctacaacgtcgtctcctggtaccagcagcaccccggcaaggcccccaagctcatcatctacgaggtctcccagcgcccctccggcgtctccaaccgcttctccggctccaagtccggcaacaccgcctccctcaccatctccggcctccagaccgaggacgaggccgactactactgctgctcctacgccggctcctccatcttcgtcatcttcggcggcggcaccaaggtcaccgtcctcggccagcccaaggccgccccctccgtcaccctcttccccccctcctccgaggagctccaggccaacaaggccaccctcgtctgcctcgtctccgacttctaccccggcgccgtcaccgtcgcctggaaggccgacggctcccccgtcaaggtcggcgtcgagaccaccaagccctccaagcagtccaacaacaagtacgccgcctcctcctacctctccctcacccccgagcagtggaagtcccaccgctcctactcctgccgcgtcacccacgagggctccaccgtcgagaagaccgtcgcccccgccgagtgctcc

SEQ ID NO: 16084 - RNA, 1353 nt, synthetic construct
  misc_feature 1..1353: note = derived and/or modified sequence opt2 from Setoxaximab_HeavyChain1
  source 1..1353: mol_type = other RNA
gaggtccagctccagcagcccggccccgagctcgagaagcccggcgcctccgtcaagctctcctgcaaggcctccggctactccttcaccgactacaacatgaactgggtcaagcagaacaacggcgagtccctcgagtggatcggcaagatcgacccctactacggcggcccctcctacaaccagaagttcaaggacaaggccaccctcaccgtcgacaagtcctcctccaccgcctacatgcagctcaagtccctcacctccgaggactccgccgtctactactgcacccgcggcggcaaccgcgactggtacttcgacgtctggggcgccggcaccaccctcaccgtctccgccgagttcgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16085 - RNA, 660 nt, synthetic construct
  misc_feature 1..660: note = derived and/or modified sequence opt2 from Setoxaximab_LightChain1
  source 1..660: mol_type = other RNA
gacatcgtcctctcccagtccccctcctccctcgtcgtctccgtcggcgagaaggtcaccatgtcctgcaagtcctcccagtccctcctctactcccgcaaccagaagaactacctcgcctggtaccagcagaagcccggccagtcccccaaggtcctcatctactgggcctccacccgcgagtccggcgtccccgaccgcctcaccggctccggctccggcaccgacttcaccctcaccatctcctccgtcaaggccgaggacctcgccgtctactactgccagcagtactactcctaccccctcaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16086 - RNA, 1338 nt, synthetic construct
  misc_feature 1..1338: note = derived and/or modified sequence opt2 from Sifalimumab_HeavyChain1
  source 1..1338: mol_type = other RNA
caggtccagctcgtccagtccggcgccgaggtcaagaagcccggcgcctccgtcaaggtctcctgcaaggcctccggctacaccttcacctcctactccatctcctgggtccgccaggcccccggccagggcctcgagtggatgggctggatctccgtctacaacggcaacaccaactacgcccagaagttccagggccgcgtcaccatgaccaccgacacctccacctccaccgcctacctcgagctccgctccctccgctccgacgacaccgccgtctactactgcgcccgcgaccccatcgccgccggctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16087 - RNA, 645 nt, synthetic construct
  misc_feature 1..645: note = derived and/or modified sequence opt2 from Sifalimumab_LightChain1
  source 1..645: mol_type = other RNA
gagatcgtcctcacccagtcccccggcaccctctccctctcccccggcgagcgcgccaccctctcctgccgcgcctcccagtccgtctcctccacctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16088 - RNA, 1347 nt, synthetic construct
  misc_feature 1..1347: note = derived and/or modified sequence opt2 from Siltuximab_HeavyChain1
  source 1..1347: mol_type = other RNA
gaggtccagctcgtcgagtccggcggcaagctcctcaagcccggcggctccctcaagctctcctgcgccgcctccggcttcaccttctcctccttcgccatgtcctggttccgccagtcccccgagaagcgcctcgagtgggtcgccgagatctcctccggcggctcctacacctactaccccgacaccgtcaccggccgcttcaccatctcccgcgacaacgccaagaacaccctctacctcgagatgtcctccctccgctccgaggacaccgccatgtactactgcgcccgcggcctctggggctactacgccctcgactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16089 - RNA, 639 nt, synthetic construct
  misc_feature 1..639: note = derived and/or modified sequence opt2 from Siltuximab_LightChain1
  source 1..639: mol_type = other RNA
cagatcgtcctcatccagtcccccgccatcatgtccgcctcccccggcgagaaggtcaccatgacctgctccgcctcctcctccgtctcctacatgtactggtaccagcagaagcccggctcctccccccgcctcctcatctacgacacctccaacctcgcctccggcgtccccgtccgcttctccggctccggctccggcacctcctactccctcaccatctcccgcatggaggccgaggacgccgccacctactactgccagcagtggtccggctacccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16090 - RNA, 1329 nt, synthetic construct
  misc_feature 1..1329: note = derived and/or modified sequence opt2 from Simtuzumab_HeavyChain1
  source 1..1329: mol_type = other RNA
caggtccagctcgtccagtccggcgccgaggtcaagaagcccggcgcctccgtcaaggtctcctgcaaggcctccggctacgccttcacctactacctcatcgagtgggtccgccaggcccccggccagggcctcgagtggatcggcgtcatcaaccccggctccggcggcaccaactacaacgagaagttcaagggccgcgccaccatcaccgccgacaagtccacctccaccgcctacatggagctctcctccctccgctccgaggacaccgccgtctacttctgcgcccgcaactggatgaacttcgactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16091 - RNA, 657 nt, synthetic construct
  misc_feature 1..657: note = derived and/or modified sequence opt2 from Simtuzumab_LightChain1
  source 1..657: mol_type = other RNA
gacatcgtcatgacccagacccccctctccctctccgtcacccccggccagcccgcctccatctcctgccgctcctccaagtccctcctccactccaacggcaacacctacctctactggttcctccagaagcccggccagtccccccagttcctcatctaccgcatgtccaacctcgcctccggcgtccccgaccgcttctccggctccggctccggcaccgacttcaccctcaagatctcccgcgtcgaggccgaggacgtcggcgtctactactgcatgcagcacctcgagtacccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16092 - RNA, 1347 nt, synthetic construct
  misc_feature 1..1347: note = derived and/or modified sequence opt2 from Sirukumab_HeavyChain1
  source 1..1347: mol_type = other RNA
gaggtccagctcgtcgagtccggcggcggcctcgtccagcccggcggctccctccgcctctcctgcgccgcctccggcttcaccttctcccccttcgccatgtcctgggtccgccaggcccccggcaagggcctcgagtgggtcgccaagatctcccccggcggctcctggacctactactccgacaccgtcaccggccgcttcaccatctcccgcgacaacgccaagaactccctctacctccagatgaactccctccgcgccgaggacaccgccgtctactactgcgcccgccagctctggggctactacgccctcgacatctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16093 - RNA, 639 nt, synthetic construct
  misc_feature 1..639: note = derived and/or modified sequence opt2 from Sirukumab_LightChain1
  source 1..639: mol_type = other RNA
gagatcgtcctcacccagtcccccgccaccctctccctctcccccggcgagcgcgccaccctctcctgctccgcctccatctccgtctcctacatgtactggtaccagcagaagcccggccaggccccccgcctcctcatctacgacatgtccaacctcgcctccggcatccccgcccgcttctccggctccggctccggcaccgacttcaccctcaccatctcctccctcgagcccgaggacttcgccgtctactactgcatgcagtggtccggctacccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16094 - RNA, 1338 nt, synthetic construct
  misc_feature 1..1338: note = derived and/or modified sequence opt2 from Sofituzumab_vedotin_HeavyChain1
  source 1..1338: mol_type = other RNA
gaggtccagctcgtcgagtccggcggcggcctcgtccagcccggcggctccctccgcctctcctgcgccgcctccggctactccatcaccaacgactacgcctggaactgggtccgccaggcccccggcaagggcctcgagtgggtcggctacatctcctactccggctacaccacctacaacccctccctcaagtcccgcttcaccatctcccgcgacacctccaagaacaccctctacctccagatgaactccctccgcgccgaggacaccgccgtctactactgcgcccgctggacctccggcctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16095 - RNA, 642 nt, synthetic construct
  misc_feature 1..642: note = derived and/or modified sequence opt2 from Sofituzumab_vedotin_LightChain1
  source 1..642: mol_type = other RNA
gacatccagatgacccagtccccctcctccctctccgcctccgtcggcgaccgcgtcaccatcacctgcaaggcctccgacctcatccacaactggctcgcctggtaccagcagaagcccggcaaggcccccaagctcctcatctacggcgccacctccctcgagaccggcgtcccctcccgcttctccggctccggctccggcaccgacttcaccctcaccatctcctccctccagcccgaggacttcgccacctactactgccagcagtactggaccacccccttcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16096 - RNA, 1323 nt, synthetic construct
  misc_feature 1..1323: note = derived and/or modified sequence opt2 from Solanezumab_HeavyChain1
  source 1..1323: mol_type = other RNA
gaggtccagctcgtcgagtccggcggcggcctcgtccagcccggcggctccctccgcctctcctgcgccgcctccggcttcaccttctcccgctactccatgtcctgggtccgccaggcccccggcaagggcctcgagctcgtcgcccagatcaactccgtcggcaactccacctactaccccgacaccgtcaagggccgcttcaccatctcccgcgacaacgccaagaacaccctctacctccagatgaactccctccgcgccgaggacaccgccgtctactactgcgcctccggcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16097 - RNA, 1326 nt, synthetic construct
  misc_feature 1..1326: note = derived and/or modified sequence opt2 from Solanezumab_HeavyChain
  source 1..1326: mol_type = other RNA
gaggtccagctcgtcgagtccggcggcggcctcgtccagcccggcggctccctccgcctctcctgcgccgcctccggcttcaccttctcccgctactccatgtcctgggtccgccaggcccccggcaagggcctcgagctcgtcgcccagatcaactccgtcggcaactccacctactaccccgacaccgtcaagggccgcttcaccatctcccgcgacaacgccaagaacaccctctacctccagatgaactccctccgcgccgaggacaccgccgtctactactgcgcctccggcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16098 - RNA, 657 nt, synthetic construct
  misc_feature 1..657: note = derived and/or modified sequence opt2 from Solanezumab_LightChain1
  source 1..657: mol_type = other RNA
gacgtcgtcatgacccagtcccccctctccctccccgtcaccctcggccagcccgcctccatctcctgccgctcctcccagtccctcatctactccgacggcaacgcctacctccactggttcctccagaagcccggccagtccccccgcctcctcatctacaaggtctccaaccgcttctccggcgtccccgaccgcttctccggctccggctccggcaccgacttcaccctcaagatctcccgcgtcgaggccgaggacgtcggcgtctactactgctcccagtccacccacgtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16099 - RNA, 1506 nt, synthetic construct
  misc_feature 1..1506: note = derived and/or modified sequence opt2 from Solitomab_HeavyChain1
  source 1..1506: mol_type = other RNA
gagctcgtcatgacccagtccccctcctccctcaccgtcaccgccggcgagaaggtcaccatgtcctgcaagtcctcccagtccctcctcaactccggcaaccagaagaactacctcacctggtaccagcagaagcccggccagccccccaagctcctcatctactgggcctccacccgcgagtccggcgtccccgaccgcttcaccggctccggctccggcaccgacttcaccctcaccatctcctccgtccaggccgaggacctcgccgtctactactgccagaacgactactcctaccccctcaccttcggcgccggcaccaagctcgagatcaagggcggcggcggctccggcggcggcggctccggcggcggcggctccgaggtccagctcctcgagcagtccggcgccgagctcgtccgccccggcacctccgtcaagatctcctgcaaggcctccggctacgccttcaccaactactggctcggctgggtcaagcagcgccccggccacggcctcgagtggatcggcgacatcttccccggctccggcaacatccactacaacgagaagttcaagggcaaggccaccctcaccgccgacaagtcctcctccaccgcctacatgcagctctcctccctcaccttcgaggactccgccgtctacttctgcgcccgcctccgcaactgggacgagcccatggactactggggccagggcaccaccgtcaccgtctcctccggcggcggcggctccgacgtccagctcgtccagtccggcgccgaggtcaagaagcccggcgcctccgtcaaggtctcctgcaaggcctccggctacaccttcacccgctacaccatgcactgggtccgccaggcccccggccagggcctcgagtggatcggctacatcaacccctcccgcggctacaccaactacgccgactccgtcaagggccgcttcaccatcaccaccgacaagtccacctccaccgcctacatggagctctcctccctccgctccgaggacaccgccacctactactgcgcccgctactacgacgaccactactgcctcgactactggggccagggcaccaccgtcaccgtctcctccggcgagggcacctccaccggctccggcggctccggcggctccggcggcgccgacgacatcgtcctcacccagtcccccgccaccctctccctctcccccggcgagcgcgccaccctctcctgccgcgcctcccagtccgtctcctacatgaactggtaccagcagaagcccggcaaggcccccaagcgctggatctacgacacctccaaggtcgcctccggcgtccccgcccgcttctccggctccggctccggcaccgactactccctcaccatcaactccctcgaggccgaggacgccgccacctactactgccagcagtggtcctccaaccccctcaccttcggcggcggcaccaaggtcgagatcaagcaccaccaccaccaccac

SEQ ID NO: 16100 - RNA, 1506 nt, synthetic construct; identical to SEQ ID NO: 16099
  misc_feature 1..1506: note = derived and/or modified sequence opt2 from Solitomab_SingleChain
  source 1..1506: mol_type = other RNA

SEQ ID NO: 16101 - RNA, 702 nt, synthetic construct
  misc_feature 1..702: note = derived and/or modified sequence opt2 from Sonepcizumab_LightChain_Precursor
  source 1..702: mol_type = other RNA
atgtccgtccccacccaggtcctcggcctcctcctcctctggctcaccgacgcccgctgcgagaccaccgtcacccagtccccctccttcctctccgcctccgtcggcgaccgcgtcaccatcacctgcatcaccaccaccgacatcgacgacgacatgaactggttccagcaggagcccggcaaggcccccaagctcctcatctccgagggcaacatcctccgccccggcgtcccctcccgcttctcctcctccggctacggcaccgacttcaccctcaccatctccaagctccagcccgaggacttcgccacctactactgcctccagtccgacaacctccccttcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16102 - RNA, 1365 nt, synthetic construct
  misc_feature 1..1365: note = derived and/or modified sequence opt2 from Sonepcizumab_gamma1-Chain_Precursor
  source 1..1365: mol_type = other RNA
atggagtggtcctgggtcttcctcttcttcctctccgtcaccaccggcgtccactccgaggtccagctcgtccagtccggcgccgaggtcaagaagcccggcgagtccctcaagatctcctgccagtccttcggctacatcttcatcgaccacaccatccactggatgcgccagatgcccggccagggcctcgagtggatgggcgccatctccccccgccacgacatcaccaagtacaacgagatgttccgcggccaggtcaccatctccgccgacaagtcctcctccaccgcctacctccagtggtcctccctcaaggcctccgacaccgccatgtacttctgcgcccgcggcggcttctacggctccaccatctggttcgacttctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16103 - RNA, 1338 nt, synthetic construct
  misc_feature 1..1338: note = derived and/or modified sequence opt2 from Stamulumab_HeavyChain1
  source 1..1338: mol_type = other RNA
gtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatgggcatcatcaacccctccggcggctccacctcctacgcccagaagttccagggccgcgtcaccatgacccgcgacacctccacctccaccgtctacatggagctctcctccctccgctccgaggacaccgccgtctactactgcgcccgcgacgagaactggggcttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16104 - RNA, 633 nt, synthetic construct
  misc_feature 1..633: note = derived and/or modified sequence opt2 from Stamulumab_LightChain1
  source 1..633: mol_type = other RNA
tcctacgagctcacccagcccccctccgtctccgtctcccccggccagaccgcctccatcacctgctccggccacgccctcggcgacaagttcgtctcctggtaccagcagaagcccggccagtcccccgtcctcgtcatctacgacgacacccagcgcccctccggcatccccgagcgcttctccggctccaactccggcaacaccgccaccctcaccatctccggcacccaggccatggacgaggccgactactactgccaggcctgggactcctccttcgtcttcggcggcggcaccaaggtcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16105 - RNA, 1356 nt, synthetic construct
  misc_feature 1..1356: note = derived and/or modified sequence opt2 from Suptavumab_HeavyChain1
  source 1..1356: mol_type = other RNA
gaggtccagctcgtcgagtccggcggcgacctcgtccagcccggccgctccctccgcctctcctgcgtcgcctccggcttcaccttcgacgactacgccatgcactgggtccgccaggcccccggcaagggcctcgagtgggtctccggcgtctcctggtccggctccaccgtcggctacgccgactccgtcaagggccgcttcaccgtctcccgcgacaacgcccagaagtccctctacctccagatgaactccctccgcgccgaggacaccgccctctactactgcgtcaaggacgcctacaagttcaactactactactacggcctcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16106 - RNA, 642 nt, synthetic construct
  misc_feature 1..642: note = derived and/or modified sequence opt2 from Suptavumab_LightChain1
  source 1..642: mol_type = other RNA
gagatcgtcatgacccagtcccccgccaccctctccgtctcccccggcgagcgcgccaccctctcctgccgcgcctcccagaccatcctctccaacctcgcctggtacctccagaagcccggccaggccccccgcctcctcatctacggcgcctccacccgcgccaccggcctccccgcccgcttctccggctccggctccggcaccgagttcaccctcaccatctcctccctccagtccgaggacttcgccgtctactactgccagcagtacaacaactggcccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16107 - RNA, 1344 nt, synthetic construct
  misc_feature 1..1344: note = derived and/or modified sequence opt2 from Suvizumab_HeavyChain1
  source 1..1344: mol_type = other RNA
caggtccagctcgtccagtccggcgccgaggtcaagaagcccggcgcctccgtcaaggtctcctgcaaggcctccggctacaccttcaccaactcctggatcggctggttccgccaggcccccggccagggcctcgagtggatcggcgacatctaccccggcggcggctacaccaactacaacgagatcttcaagggcaaggccaccatgaccgccgacacctccaccaacaccgcctacatggagctctcctccctccgctccgaggacaccgccgtctactactgctcccgcggcatccccggctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16108 - RNA, 660 nt, synthetic construct
  misc_feature 1..660: note = derived and/or modified sequence opt2 from Suvizumab_LightChain1
  source 1..660: mol_type = other RNA
gacatccagatgacccagcgccccgactccctctccgcctccgtcggcgaccgcgtcaccatgtcctgcaagtcctcccagtccctcctcaactccggcgaccagaagaactacctcacctggtaccagcagaagcccggccagccccccaagctcctcatctactgggcctccaccggcgagtccggcgtccccgaccgcttctccggctccggctccggcaccgacttcaccttcaccatctcctccctccagcccgaggacatcgccacctactactgccagaacgactactcctacccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16109 - RNA, 1350 nt, synthetic construct
  misc_feature 1..1350: note = derived and/or modified sequence opt2 from Tabalumab_HeavyChain1
  source 1..1350: mol_type = other RNA
caggtccagctccagcagtggggcgccggcctcctcaagccctccgagaccctctccctcacctgcgccgtctacggcggctccttctccggctactactggtcctggatccgccagccccccggcaagggcctcgagtggatcggcgagatcaaccactccggctccaccaactacaacccctccctcaagtcccgcgtcaccatctccgtcgacacctccaagaaccagttctccctcaagctctcctccgtcaccgccgccgacaccgccgtctactactgcgcccgcggctactacgacatcctcaccggctactactactacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16110 - RNA, 642 nt, synthetic construct
  misc_feature 1..642: note = derived and/or modified sequence opt2 from Tabalumab_LightChain1
  source 1..642: mol_type = other RNA
gagatcgtcctcacccagtcccccgccaccctctccctctcccccggcgagcgcgccaccctctcctgccgcgcctcccagtccgtctcccgctacctcgcctggtaccagcagaagcccggccaggccccccgcctcctcatctacgacgcctccaaccgcgccaccggcatccccgcccgcttctccggctccggctccggcaccgactccaccctcaccatctcctccctcgagcccgaggacttcgccgtctactactgccagcagcgctccaactggccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctccaacaccctcaccctctccaaggccgactacgagaagcacaaggtctacgcctgcgaggtcacccaccagggcctctcctcccccgtcaccaagtccttcaaccgcggcgagtgc

SEQ ID NO: 16111 - RNA, 1332 nt, synthetic construct
  misc_feature 1..1332: note = derived and/or modified sequence opt2 from Tacatuzuab_HeavyChain1
  source 1..1332: mol_type = other RNA
caggtccagctccagcagtccggcgccgaggtcaagaagcccggctcctccgtcaaggtctcctgcaaggcctccggctacgccttcacctcctacgtcatccactgggtccgccaggcccccggccagggcctctactggatcggctacatccacccctacaacggcggcaccaagtacaacgagaagttcaagggcaaggccaccatcaccgccgacgagtccaccaacaccgcctacgagctctcctccctccgctccgaggacaccgccttctacttctgcgcccgctccggcggcggcgaccccttcgcctactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 16112 - RNA, 636 nt, synthetic construct
  misc_feature 1..636: note = derived and/or modified sequence opt2 from Tacatuzuab_LightChain1
  source 1..636: mol_type = other RNA
gacatccagctcacccagtccccctcctccctctccgcctccgtcggcgaccgcgtcaccatcacctgcaaggcctcccaggacatcaacaagtacatcggctggtaccagcagaagcccggcaaggcccccaagctcctccactacacctccgccctcctccccggcatcccctcccgcttctccggctccggctccggccgcgactacaccttcaccatctcctccctccagcccgaggacatcgccacctactactgcctccagtacgacgacctctggaccttcggcggcggcaccaagctccagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16113 - RNA, 678 nt, synthetic construct
  misc_feature 1..678: note = derived and/or modified sequence opt2 from Tadocizumab_fab_fragment_HeavyChain
  source 1..678: mol_type = other RNA
caggtccagctcgtccagtccggcgccgaggtcaagaagcccggctcctccgtcaaggtctcctgcaaggcctccggctacgccttcaccaactacctcatcgagtgggtccgccaggcccccggccagggcctcgagtggatcggcgtcatctaccccggctccggcggcaccaactacaacgagaagttcaagggccgcgtcaccctcaccgtcgacgagtccaccaacaccgcctacatggagctctcctccctccgctccgaggacaccgccgtctacttctgcgcccgccgcgacggcaactacggctggttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccac

SEQ ID NO: 16114 - RNA, 582 nt, synthetic construct
  misc_feature 1..582: note = derived and/or modified sequence opt2 from Tadocizumab_fab_fragment_LightChain
  source 1..582: mol_type = other RNA
gacatccagatgacccagaccccctccaccctctccgcctccgtcggcgaccgcgtcaccatctcctgccgcgcctcccaggacatcaacaactacctcaactggtaccagcagaagcccggcaaggcccccaagctcctcatctactacacctccaccctccactccggcgtcccctcccgcttctccggctccggctccggcaccgactacaccctcaccatctcctccctccagcccgacgacttcgccacctacttctgccagcagggcaacaccctcccctggaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacgagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16115 - RNA, 1359 nt, synthetic construct
  misc_feature 1..1359: note = derived and/or modified sequence opt2 from Talizumab_HeavyChain1
  source 1..1359: mol_type = other RNA
caggtccagctcgtccagtccggcgccgaggtcaagaagcccggcgcctccgtcaaggtctcctgcaaggcctccggctacaccttctccatgtactggctcgagtgggtccgccaggcccccggccacggcctcgagtgggtcggcgagatctcccccggcaccttcaccaccaactacaacgagaagttcaaggcccgcgccaccttcaccgccgacacctccaccaacaccgcctacatggagctctcctccctccgctccgaggacaccgccgtctactactgcgcccgcttctcccacttctccggctccaactacgactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16116 - RNA, 642 nt, synthetic construct
  misc_feature 1..642: note = derived and/or modified sequence opt2 from Talizumab_LightChain1
  source 1..642: mol_type = other RNA
gacatcctcctcacccagtcccccggcaccctctccctctcccccggcgagcgcgccaccctctcctgccgcgcctcccagtccatcggcaccaacatccactggtaccagcagaagcccggccaggccccccgcctcctcatcaagtacgcctccgagtccatctccggcatcccctcccgcttctccggctccggctccggcaccgacttcaccctcaccatctcccgcctcgagcccgaggacttcgccatgtactactgccagcagtccgactcctggcccaccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16117 - RNA, 1368 nt, synthetic construct
  misc_feature 1..1368: note = derived and/or modified sequence opt2 from Tamtuvetmab_HeavyChain1
  source 1..1368: mol_type = other RNA
gaggtcaagctcctcgagtccggcggcggcctcgtccagcccggcggctccatgcgcctctcctgcgccggctccggcttcaccttcaccgacttctacatgaactggatccgccagcccgccggcaaggcccccgagtggctcggcttcatccgcgacaaggccaagggctacaccaccgagtacaacccctccgtcaagggccgcttcaccatctcccgcgacaacacccagaacatgctctacctccagatgaacaccctccgcgccgaggacaccgccacctactactgcgcccgcgagggccacaccgccgcccccttcgactactggggccagggcaccctcgtcaccgtctcctccgcctccaccaccgccccctccgtcttccccctcgccccctcctgcggctccacctccggctccaccgtcgccctcgcctgcctcgtctccggctacttccccgagcccgtcaccgtctcctggaactccggctccctcacctccggcgtccacaccttcccctccgtcctccagtcctccggcctctactccctctcctccatggtcaccgtcccctcctcccgctggccctccgagaccttcacctgcaacgtcgcccaccccgcctccaagaccaaggtcgacaagcccgtccccaagcgcgagaacggccgcgtcccccgcccccccgactgccccaagtgccccgcccccgagatgctcggcggcccctccgtcttcatcttcccccccaagcccaaggacaccctcctcatcgcccgcacccccgaggtcacctgcgtcgtcgtcgacctcgaccccgaggaccccgaggtccagatctcctggttcgtcgacggcaagcagatgcagaccgccaagacccagccccgcgaggagcagttcaacggcacctaccgcgtcgtctccgtcctccccatcggccaccaggactggctcaagggcaagcagttcacctgcaaggtcaacaacaaggccctcccctcccccatcgagcgcaccatctccaaggcccgcggccaggcccaccagccctccgtctacgtcctccccccctcccgcgaggagctctccaagaacaccgtctccctcacctgcctcatcaaggacttcttcccccccgacatcgacgtcgagtggcagtccaacggccagcaggagcccgagtccaagtaccgcaccacccccccccagctcgacgaggacggctcctacttcctctactccaagctctccgtcgacaagtcccgctggcagcgcggcgacaccttcatctgcgccgtcatgcacgaggccctccacaaccactacacccagaagtccctctcccactcccccggcaag

SEQ ID NO: 16118 - RNA, 639 nt, synthetic construct
  misc_feature 1..639: note = derived and/or modified sequence opt2 from Tamtuvetmab_LightChain1
  source 1..639: mol_type = other RNA
gacatcaagatgacccagtccccctccttcctctccgcctccgtcggcgaccgcgtcaccctcaactgcaaggcctcccagaacatcgacaagtacctcaactggtaccagcagaagctcggcgagtcccccaagctcctcatctacaacaccaacaacctccagaccggcatcccctcccgcttctccggctccggctccggcaccgacttcaccctcaccatctcctccctccagcccgaggacgtcgccacctacttctgcctccagcacatctcccgcccccgcaccttcggcggcggcacccacctcaccgtcctcggccagcccaaggcctccccctccgtcaccctcttccccccctcctccgaggagctcggcgccaacaaggccaccctcgtctgcctcatctccgacttctacccctccggcgtcaccgtcgcctggaaggccgacggctcccccatcacccagggcgtcgagaccaccaagccctccaagcagtccaacaacaagtacgccgcctcctcctacctctccctcacccccgacaagtggaagtcccactcctccttctcctgcctcgtcacccacgagggctccaccgtcgagaagaaggtcgcccccgccgagtgctcc

SEQ ID NO: 16119 - RNA, 360 nt, synthetic construct
  misc_feature 1..360: note = derived and/or modified sequence opt2 from Tanezumab_HeavyChain
  source 1..360: mol_type = other RNA
caggtccagctccaggagtccggccccggcctcgtcaagccctccgagaccctctccctcacctgcaccgtctccggcttctccctcatcggctacgacctcaactggatccgccagccccccggcaagggcctcgagtggatcggcatcatctggggcgacggcaccaccgactacaactccgccgtcaagtcccgcgtcaccatctccaaggacacctccaagaaccagttctccctcaagctctcctccgtcaccgccgccgacaccgccgtctactactgcgcccgcggcggctactggtacgccacctcctactacttcgactactggggccagggcaccctcgtcaccgtctcc

SEQ ID NO: 16120 - RNA, 327 nt, synthetic construct
  misc_feature 1..327: note = derived and/or modified sequence opt2 from Tanezumab_LightChain
  source 1..327: mol_type = other RNA
gacatccagatgacccagtccccctcctccctctccgcctccgtcggcgaccgcgtcaccatcacctgccgcgcctcccagtccatctccaacaacctcaactggtaccagcagaagcccggcaaggcccccaagctcctcatctactacacctcccgcttccactccggcgtcccctcccgcttctccggctccggctccggcaccgacttcaccttcaccatctcctccctccagcccgaggacatcgccacctactactgccagcaggagcacaccctcccctacaccttcggccagggcaccaagctcgagatcaagcgcacc

SEQ ID NO: 16121 - RNA, 1323 nt, synthetic construct
  misc_feature 1..1323: note = derived and/or modified sequence opt2 from Tarextumab_HeavyChain1
  source 1..1323: mol_type = other RNA
gaggtccagctcgtcgagtccggcggcggcctcgtccagcccggcggctccctccgcctctcctgcgccgcctccggcttcaccttctcctcctccggcatgtcctgggtccgccaggcccccggcaagggcctcgagtgggtctccgtcatcgcctcctccggctccaacacctactacgccgactccgtcaagggccgcttcaccatctcccgcgacaactccaagaacaccctctacctccagatgaactccctccgcgccgaggacaccgccgtctactactgcgcccgctccatcttctacaccacctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16122 - RNA, 645 nt, synthetic construct
  misc_feature 1..645: note = derived and/or modified sequence opt2 from Tarextumab_LightChain1
  source 1..645: mol_type = other RNA
gacatcgtcctcacccagtcccccgccaccctctccctctcccccggcgagcgcgccaccctctcctgccgcgcctcccagtccgtccgctccaactacctcgcctggtaccagcagaagcccggccaggccccccgcctcctcatctacggcgcctcctcccgcgccaccggcgtccccgcccgcttctccggctccggctccggcaccgacttcaccctcaccatctcctccctcgagcccgaggacttcgccgtctactactgccagcagtactccaacttccccatcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16123 - RNA, 363 nt, synthetic construct
  misc_feature 1..363: note = derived and/or modified sequence opt2 from Tefibazumab_HeavyChain1
  source 1..363: mol_type = other RNA
caggtccagctcaaggagtccggccccggcctcgtcaagccctcccagaccctctccatcacctgcaccatctccggcttctccctctcccgctactccgtccactgggtccgccagccccccggcaagggcctcgagtggctcggcatgatctggggcggcggcaacaccgactacaactccgccctcaagtcccgcctctccatctccaaggacaactccaagaaccaggtcttcctcaagatgaactccctcaccgccgccgacaccgccgtctactactgcgcccgcaagggcgagttctactacggctacgacggcttcgtctactggggccagggcaccctcgtcaccgtctcctcc

SEQ ID NO: 16124 - RNA, 336 nt, synthetic construct
  misc_feature 1..336: note = derived and/or modified sequence opt2 from Tefibazumab_LightChain1
  source 1..336: mol_type = other RNA
gacatcgtcatgacccagtcccccgactccctcgccgtctccctcggcgagcgcgtcaccatgaactgcaagtcctcccagtccgtcctctactcctccaaccagaagaactacctcgcctggtaccagcagaagcccggccagtcccccaagctcctcatctactgggcctccacccgcgagtccggcgtccccgaccgcttctccggctccggctccggcaccgacttcaccctcaccatctcctccgtccaggccgaggacctcgccgtctactactgccaccagtacctctcctcctacaccttcggcggcggcaccaagctcgagatcaag

SEQ ID NO: 16125 - RNA, 1368 nt, synthetic construct
  misc_feature 1..1368: note = derived and/or modified sequence opt2 from Tenatumomab_HeavyChain1
  source 1..1368: mol_type = other RNA
gagatccagctccagcagtccggccccgagctcgtcaagcccggcgcctccgtcaaggtctcctgcaaggcctccggctacgccttcacctcctacaacatgtactgggtcaagcagtcccacggcaagtccctcgagtggatcggctacatcgacccctacaacggcgtcacctcctacaaccagaagttcaagggcaaggccaccctcaccgtcgacaagtcctcctccaccgcctacatgcacctcaactccctcacctccgaggactccgccgtctactactgcgcccgcggcggcggctccatctactacgccatggactactggggccagggcacctccgtcaccgtctcctccgccaagaccacccccccctccgtctaccccctcgcccccggctgcggcgacaccaccggctcctccgtcaccctcggctgcctcgtcaagggctacttccccgagtccgtcaccgtcacctggaactccggctccctctcctcctccgtccacaccttccccgccctcctccagtccggcctctacaccatgtcctcctccgtcaccgtcccctcctccacctggccctcccagaccgtcacctgctccgtcgcccaccccgcctcctccaccaccgtcgacaagaagctcgagccctccggccccatctccaccatcaacccctgccccccctgcaaggagtgccacaagtgccccgcccccaacctcgagggcggcccctccgtcttcatcttcccccccaacatcaaggacgtcctcatgatctccctcacccccaaggtcacctgcgtcgtcgtcgacgtctccgaggacgaccccgacgtccagatctcctggttcgtcaacaacgtcgaggtccacaccgcccagacccagacccaccgcgaggactacaactccaccatccgcgtcgtctccaccctccccatccagcaccaggactggatgtccggcaaggagttcaagtgcaaggtcaacaacaaggacctcccctcccccatcgagcgcaccatctccaagatcaagggcctcgtccgcgccccccaggtctacatcctccccccccccgccgagcagctctcccgcaaggacgtctccctcacctgcctcgtcgtcggcttcaaccccggcgacatctccgtcgagtggacctccaacggccacaccgaggagaactacaaggacaccgcccccgtcctcgactccgacggctcctacttcatctactccaagctcaacatgaagacctccaagtgggagaagaccgactccttctcctgcaacgtccgccacgagggcctcaagaactactacctcaagaagaccatctcccgctcccccggcaag

SEQ ID NO: 16126 - RNA, 657 nt, synthetic construct
  misc_feature 1..657: note = derived and/or modified sequence opt2 from Tenatumomab_LightChain1
  source 1..657: mol_type = other RNA
gacatcgtcatgacccaggccgccccctccgtccccgtcacccccggcgagtccgtctccatctcctgccgctcctccaagtccctcctccactccaacggcaacacctacctctactggttcctccagcgccccggccagtccccccagctcctcatctaccgcatgtccaacctcgcctccggcgtccccgaccgcttctccggctccggctccggcaccgccttcaccctccgcatctcccgcgtcgaggccgaggacgtcggcgtctactactgcatgcagcacctcgagtaccccctcaccttcggcgccggcaccaagctcgagctcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 16127 - RNA, 1356 nt, synthetic construct
  misc_feature 1..1356: note = derived and/or modified sequence opt2 from Teneliximab_HeavyChain1
  source 1..1356: mol_type = other RNA
cagatccagctcgtccagtccggccccgagctcaagaagcccggcgagaccgtccgcatctcctgcaaggcctccggctacgccttcaccaccaccggcatgcagtgggtccaggagatgcccggcaagggcctcaagtggatcggctggatcaacacccactccggcgtccccaagtacgtcgaggacttcaagggccgcttcgccttctccctcgagacctccgccaacaccgcctacctccagatctccaacctcaagaacgaggacaccgccacctacttctgcgtccgctccggcaacggcaactacgacctcgcctacttcgcctactggggccagggcaccctcgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16128 - RNA, 642 nt, synthetic construct
  misc_feature 1..642: note = derived and/or modified sequence opt2 from Teneliximab_LightChain1
  source 1..642: mol_type = other RNA
gacatcgtcctcacccagtcccccgccaccctctccgtcacccccggcgaccgcgtctccctctcctgccgcgcctcccagtccatctccgactacctccactggtaccagcagaagtcccacgagtccccccgcctcctcatcaagtacgcctcccactccatctccggcatcccctcccgcttctccggctccggctccggctccgacttcaccctctccatcaactccgtcgagcccgaggacgtcggcatctactactgccagcacggccactccttcccctggaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16129 - RNA, 1347 nt, synthetic construct
  misc_feature 1..1347: note = derived and/or modified sequence opt2 from Teplizumab_HeavyChain1
  source 1..1347: mol_type = other RNA
caggtccagctcgtccagtccggcggcggcgtcgtccagcccggccgctccctccgcctctcctgcaaggcctccggctacaccttcacccgctacaccatgcactgggtccgccaggcccccggcaagggcctcgagtggatcggctacatcaacccctcccgcggctacaccaactacaaccagaaggtcaaggaccgcttcaccatctcccgcgacaactccaagaacaccgccttcctccagatggactccctccgccccgaggacaccggcgtctacttctgcgcccgctactacgacgaccactactgcctcgactactggggccagggcacccccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16130 - RNA, 639 nt, synthetic construct
  misc_feature 1..639: note = derived and/or modified sequence opt2 from Teplizumab_LightChain1
  source 1..639: mol_type = other RNA
gacatccagatgacccagtccccctcctccctctccgcctccgtcggcgaccgcgtcaccatcacctgctccgcctcctcctccgtctcctacatgaactggtaccagcagacccccggcaaggcccccaagcgctggatctacgacacctccaagctcgcctccggcgtcccctcccgcttctccggctccggctccggcaccgactacaccttcaccatctcctccctccagcccgaggacatcgccacctactactgccagcagtggtcctccaaccccttcaccttcggccagggcaccaagctccagatcacccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16131 - RNA, 1344 nt, synthetic construct
  misc_feature 1..1344: note = derived and/or modified sequence opt2 from Teprotumumab_HeavyChain1
  source 1..1344: mol_type = other RNA
caggtcgagctcgtcgagtccggcggcggcgtcgtccagcccggccgctcccagcgcctctcctgcgccgcctccggcttcaccttctcctcctacggcatgcactgggtccgccaggcccccggcaagggcctcgagtgggtcgccatcatctggttcgacggctcctccacctactacgccgactccgtccgcggccgcttcaccatctcccgcgacaactccaagaacaccctctacctccagatgaactccctccgcgccgaggacaccgccgtctacttctgcgcccgcgagctcggccgccgctacttcgacctctggggccgcggcaccctcgtctccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16132 - RNA, 645 nt, synthetic construct
  misc_feature 1..645: note = derived and/or modified sequence opt2 from Teprotumumab_LightChain1
  source 1..645: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaagcgcgccaccggcatccccgcccgcttctccggctccggctccggcaccgacttcaccctcaccatctcctccctcgagcccgaggacttcgccgtctactactgccagcagcgctccaagtggcccccctggaccttcggccagggcaccaaggtcgagtccaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16133 - RNA, 1338 nt, synthetic construct
  misc_feature 1..1338: note = derived and/or modified sequence opt2 from Tesidolumab_HeavyChain1
  source 1..1338: mol_type = other RNA
gaggtccagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcggccccttcttcggcaccgccaactacgcccagaagttccagggccgcgtcaccatcaccgccgacgagtccacctccaccgcctacatggagctctcctccctccgctccgaggacaccgccgtctactactgcgcccgcgacaccccctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16134 - RNA, 642 nt, synthetic construct
  misc_feature 1..642: note = derived and/or modified sequence opt2 from Tesidolumab_LightChain1
  source 1..642: mol_type = other RNA
tcctacgagctcacccagcccctctccgtctccgtcgccctcggccagaccgcccgcatcacctgctccggcgactccatccccaactactacgtctactggtaccagcagaagcccggccaggcccccgtcctcgtcatctacgacgactccaaccgcccctccggcatccccgagcgcttctccggctccaactccggcaacaccgccaccctcaccatctcccgcgcccaggccggcgacgaggccgactactactgccagtccttcgactcctccctcaacgccgaggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16135 - RNA, 1344 nt, synthetic construct
  misc_feature 1..1344: note = derived and/or modified sequence opt2 from Tezepelumab_HeavyChain1
  source 1..1344: mol_type = other RNA
cagatgcagctcgtcgagtccggcggcggcgtcgtccagcccggccgctccctccgcctctcctgcgccgcctccggcttcaccttccgcacctacggcatgcactgggtccgccaggcccccggcaagggcctcgagtgggtcgccgtcatctggtacgacggctccaacaagcactacgccgactccgtcaagggccgcttcaccatcacccgcgacaactccaagaacaccctcaacctccagatgaactccctccgcgccgaggacaccgccgtctactactgcgcccgcgccccccagtgggagctcgtccacgaggccttcgacatctggggccagggcaccatggtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16136 - RNA, 642 nt, synthetic construct
  misc_feature 1..642: note = derived and/or modified sequence opt2 from Tezepelumab_LightChain1
  source 1..642: mol_type = other RNA
tcctacgtcctcacccagcccccctccgtctccgtcgcccccggccagaccgcccgcatcacctgcggcggcaacaacctcggctccaagtccgtccactggtaccagcagaagcccggccaggcccccgtcctcgtcgtctacgacgactccgaccgcccctcctggatccccgagcgcttctccggctccaactccggcaacaccgccaccctcaccatctcccgcggcgaggccggcgacgaggccgactactactgccaggtctgggactcctcctccgaccacgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16137 - RNA, 1338 nt, synthetic construct
  misc_feature 1..1338: note = derived and/or modified sequence opt2 from ThioMAb-chMA79b-HC(A118C)_HeavyChain
  source 1..1338: mol_type = other RNA
gaggtccagctccagcagtccggcgccgagctcatgaagcccggcgcctccgtcaagatctcctgcaaggccaccggctacaccttctcctcctactggatcgagtgggtcaagcagcgccccggccacggcctcgagtggatcggcgagatcctccccggcggcggcgacaccaactacaacgagatcttcaagggcaaggccaccttcaccgccgacacctcctccaacaccgcctacatgcagctctcctccctcacctccgaggactccgccgtctactactgcacccgccgcgtccccgtctacttcgactactggggccagggcacctccgtcaccgtctcctcctgctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16138 - RNA, 1347 nt, synthetic construct
  misc_feature 1..1347: note = derived and/or modified sequence opt2 from ThioMab-hu10A8.v1-HC(A118C)_HeavyChain
  source 1..1347: mol_type = other RNA
gaggtccagctcgtcgagtccggcggcggcctcgtccagcccggcggctccctccgcctctcctgcgccgcctccggcttcaccttctcctcctacgccgtctcctgggtccgccaggcccccggcaagggcctcgagtgggtcgccaccatctcctccggcggctccctcaccttctacctcgactccgtccgcggccgcttcaccatctcccgcgacaactccaagaacaccctctacctccagatgaactccctccgcgccgaggacaccgccgtctactactgcgcccgccccatccccgactactacgccctcgactactggggccagggcaccctcgtcaccgtctcctcctgctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16139 - RNA, 1347 nt, synthetic construct
  misc_feature 1..1347: note = derived and/or modified sequence opt2 from ThioMab-hu10A8.v1-HC(V205C)_HeavyChain
  source 1..1347: mol_type = other RNA
gaggtccagctcgtcgagtccggcggcggcctcgtccagcccggcggctccctccgcctctcctgcgccgcctccggcttcaccttctcctcctacgccgtctcctgggtccgccaggcccccggcaagggcctcgagtgggtcgccaccatctcctccggcggctccctcaccttctacctcgactccgtccgcggccgcttcaccatctcccgcgacaactccaagaacaccctctacctccagatgaactccctccgcgccgaggacaccgccgtctactactgcgcccgccccatccccgactactacgccctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16140 - RNA, 642 nt, synthetic construct
  misc_feature 1..642: note = derived and/or modified sequence opt2 from ThioMab-hu10A8.v1-LC(A118C)_LightChain
  source 1..642: mol_type = other RNA
gacatccagatgacccagtccccctcctccctctccgcctccgtcggcgaccgcgtcaccatcacctgcaaggcctcccaggacgtctccaccgccgtcgcctggtaccagcagaagcccggcaaggcccccaagctcctcatctactccgcctcctaccgctacaccggcgtcccctcccgcttctccggctccggctccggcaccgacttcaccctcaccatctcctccctccagcccgaggacttcgccacctactactgccagcagcacttctcctccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16141 - RNA, 642 nt, synthetic construct
  misc_feature 1..642: note = derived and/or modified sequence opt2 from ThioMab-hu10A8.v1-LC(V205C)_LightChain
  source 1..642: mol_type = other RNA
gacatccagatgacccagtccccctcctccctctccgcctccgtcggcgaccgcgtcaccatcacctgcaaggcctcccaggacgtctccaccgccgtcgcctggtaccagcagaagcccggcaaggcccccaagctcctcatctactccgcctcctaccgctacaccggcgtcccctcccgcttctccggctccggctccggcaccgacttcaccctcaccatctcctccctccagcccgaggacttcgccacctactactgccagcagcacttctcctccccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctccccctgcaccaagtccttcaaccgcggcgagtgc

SEQ ID NO: 16142 - RNA, 1338 nt, synthetic construct
  misc_feature 1..1338: note = derived and/or modified sequence opt2 from ThioMAb-huMA79b.v17-HC(A118C)_HeavyChain
  source 1..1338: mol_type = other RNA
gaggtccagctcgtcgagtccggcggcggcctcgtccagcccggcggctccctccgcctctcctgcgccgcctccggctacaccttctcctcctactggatcgagtgggtccgccaggcccccggcaagggcctcgagtggatcggcgagatcctccccggcggcggcgacaccaactacaacgagatcttcaagggccgcgccaccttctccgccgacacctccaagaacaccgcctacctccagatgaactccctccgcgccgaggacaccgccgtctactactgcacccgccgcgtccccgtctacttcgactactggggccagggcaccctcgtcaccgtctcctcctgctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16143 - RNA, 654 nt, synthetic construct
  misc_feature 1..654: note = derived and/or modified sequence opt2 from ThioMAb-huMA79b.v17-HC(A118C)_LightChain
  source 1..654: mol_type = other RNA
gacatccagctcacccagtccccctcctccctctccgcctccgtcggcgaccgcgtcaccatcacctgcaaggcctcccagtccgtcgactacgacggcgactccttcctcaactggtaccagcagaagcccggcaaggcccccaagctcctcatctacgccgcctccaacctcgagtccggcgtcccctcccgcttctccggctccggctccggcaccgacttcaccctcaccatctcctccctccagcccgaggacttcgccacctactactgccagcagtccaacgaggaccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16144 - RNA, 1338 nt, synthetic construct
  misc_feature 1..1338: note = derived and/or modified sequence opt2 from ThioMAb-huMA79b.v18-HC(A118C)_HeavyChain
  source 1..1338: mol_type = other RNA
gaggtccagctcgtcgagtccggcggcggcctcgtccagcccggcggctccctccgcctctcctgcgccgcctccggctacaccttctcctcctactggatcgagtgggtccgccaggcccccggcaagggcctcgagtggatcggcgagatcctccccggcggcggcgacaccaactacaacgagatcttcaagggccgcgccaccttctccgccgacacctccaagaacaccgcctacctccagatgaactccctccgcgccgaggacaccgccgtctactactgcacccgccgcgtccccatccgcctcgactactggggccagggcaccctcgtcaccgtctcctcctgctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16145 - RNA, 654 nt, synthetic construct; identical to SEQ ID NO: 15989
  misc_feature 1..654: note = derived and/or modified sequence opt2 from ThioMAb-huMA79b.v28-HC(A118C)_LightChain
  source 1..654: mol_type = other RNA

SEQ ID NO: 16146 - RNA, 654 nt, synthetic construct
  misc_feature 1..654: note = derived and/or modified sequence opt2 from ThioMAb-huMA79b.v28-LC(V205C)_LightChain
  source 1..654: mol_type = other RNA
gacatcgtcctcacccagtcccccgcctccctcgccgtctccctcggccagcgcgccaccatctcctgcaaggcctcccagtccgtcgactacgacggcgactccttcctcaactggtaccagcagaagcccggccagccccccaagctcttcatctacgccgcctccaacctcgagtccggcatccccgcccgcttctccggctccggctccggcaccgacttcaccctcaacatccaccccgtcgaggaggaggacgccgccacctactactgccagcagtccaacgaggaccccctcaccttcggcgccggcaccgagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctccccctgcaccaagtccttcaaccgcggcgagtgc

SEQ ID NO: 16147 - RNA, 1332 nt, synthetic construct
  misc_feature 1..1332: note = derived and/or modified sequence opt2 from Ticiliuab_HeavyChain1
  source 1..1332: mol_type = other RNA
caggtccagctcgtcgagtccggcggcggcgtcgtccagcccggccgctccctccgcctctcctgcgccgcctccggcttcaccttctcctcctacggccactgggtccgccaggcccccggcaagggcctcgagtgggtcgccgtcatctggtacgacggctccaacaagtactacgccgactccgtcaagggccgcttcaccatctcccgcgacaactccaagaacaccctctacctccagaactccctccgcgccgaggacaccgccgtctactactgcgcccgcgacccccgcggcgccaccctctactactactactacggcgacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 16148 - RNA, 639 nt, synthetic construct
  misc_feature 1..639: note = derived and/or modified sequence opt2 from Ticiliuab_LightChain1
  source 1..639: mol_type = other RNA
gacatccagacccagtccccctcctccctctccgcctccgtcggcgaccgcgtcaccatcacctgccgcgcctcccagtccatcaactcctacctcgactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagtactactccacccccttcaccttcggccccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16149 - RNA, 1347 nt, synthetic construct
  misc_feature 1..1347: note = derived and/or modified sequence opt2 from Tigatuzumab_HeavyChain1
  source 1..1347: mol_type = other RNA
gaggtccagctcgtcgagtccggcggcggcctcgtccagcccggcggctccctccgcctctcctgcgccgcctccggcttcaccttctcctcctacgtcatgtcctgggtccgccaggcccccggcaagggcctcgagtgggtcgccaccatctcctccggcggctcctacacctactaccccgactccgtcaagggccgcttcaccatctcccgcgacaacgccaagaacaccctctacctccagatgaactccctccgcgccgaggacaccgccgtctactactgcgcccgccgcggcgactccatgatcaccaccgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16150 - RNA, 1347 nt, synthetic construct; identical to SEQ ID NO: 16149
  misc_feature 1..1347: note = derived and/or modified sequence opt2 from Tigatuzumab_HeavyChain
  source 1..1347: mol_type = other RNA

SEQ ID NO: 16151 - RNA, 639 nt, synthetic construct
  misc_feature 1..639: note = derived and/or modified sequence opt2 from Tigatuzumab_LightChain1
  source 1..639: mol_type = other RNA
gacatccagatgacccagtccccctcctccctctccgcctccgtcggcgaccgcgtcaccatcacctgcaaggcctcccaggacgtcggcaccgccgtcgcctggtaccagcagaagcccggcaaggcccccaagctcctcatctactgggcctccacccgccacaccggcgtcccctcccgcttctccggctccggctccggcaccgacttcaccctcaccatctcctccctccagcccgaggacttcgccacctactactgccagcagtactcctcctaccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16152 - RNA, 639 nt, synthetic construct; identical to SEQ ID NO: 16151
  misc_feature 1..639: note = derived and/or modified sequence opt2 from Tigatuzumab_LightChain
  source 1..639: mol_type = other RNA

SEQ ID NO: 16153 - RNA, 1338 nt, synthetic construct
  misc_feature 1..1338: note = derived and/or modified sequence opt2 from Tildrakizumab_HeavyChain1
  source 1..1338: mol_type = other RNA
caggtccagctcgtccagtccggcgccgaggtcaagaagcccggcgcctccgtcaaggtctcctgcaaggcctccggctacatcttcatcacctactggatgacctgggtccgccaggcccccggccagggcctcgagtggatgggccagatcttccccgcctccggctccgccgactacaacgagaagttcgagggccgcgtcaccatgaccaccgacacctccacctccaccgcctacatggagctccgctccctccgctccgacgacaccgccgtctactactgcgcccgcggcggcggcggcttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16154 - RNA, 642 nt, synthetic construct
  misc_feature 1..642: note = derived and/or modified sequence opt2 from Tildrakizumab_LightChain1
  source 1..642: mol_type = other RNA
gacatccagatgacccagtccccctcctccctctccgcctccgtcggcgaccgcgtcaccatcacctgccgcacctccgagaacatctactcctacctcgcctggtaccagcagaagcccggcaaggcccccaagctcctcatctacaacgccaagaccctcgccgagggcgtcccctcccgcttctccggctccggctccggcaccgacttcaccctcaccatctcctccctccagcccgaggacttcgccacctactactgccagcaccactacggcatccccttcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16155 - RNA, 1344 nt, synthetic construct
  misc_feature 1..1344: note = derived and/or modified sequence opt2 from Tisotumab_vedotin_HeavyChain1
  source 1..1344: mol_type = other RNA
gaggtccagctcctcgagtccggcggcggcctcgtccagcccggcggctccctccgcctctcctgcgccgcctccggcttcaccttctccaactacgccatgtcctgggtccgccaggcccccggcaagggcctcgagtgggtctcctccatctccggctccggcgactacacctactacaccgactccgtcaagggccgcttcaccatctcccgcgacaactccaagaacaccctctacctccagatgaactccctccgcgccgaggacaccgccgtctactactgcgcccgctccccctggggctactacctcgactcctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16156 - RNA, 642 nt, synthetic construct
  misc_feature 1..642: note = derived and/or modified sequence opt2 from Tisotumab_vedotin_LightChain1
  source 1..642: mol_type = other RNA
gacatccagatgacccagtcccccccctccctctccgcctccgccggcgaccgcgtcaccatcacctgccgcgcctcccagggcatctcctcccgcctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16157 - RNA, 1341 nt, synthetic construct
  misc_feature 1..1341: note = derived and/or modified sequence opt2 from Tocilizumab_HeavyChain1
  source 1..1341: mol_type = other RNA
gtccagctccaggagtccggccccggcctcgtccgcccctcccagaccctctccctcacctgcaccgtctccggctactccatcacctccgaccacgcctggtcctgggtccgccagccccccggccgcggcctcgagtggatcggctacatctcctactccggcatcaccacctacaacccctccctcaagtcccgcgtcaccatgctccgcgacacctccaagaaccagttctccctccgcctctcctccgtcaccgccgccgacaccgccgtctactactgcgcccgctccctcgcccgcaccaccgccatggactactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16158 - RNA, 642 nt, synthetic construct
  misc_feature 1..642: note = derived and/or modified sequence opt2 from Tocilizumab_LightChain1
  source 1..642: mol_type = other RNA
gacatccagatgacccagtccccctcctccctctccgcctccgtcggcgaccgcgtcaccatcacctgccgcgcctcccaggacatctcctcctacctcaactggtaccagcagaagcccggcaaggcccccaagctcctcatctactacacctcccgcctccactccggcgtcccctcccgcttctccggctccggctccggcaccgacttcaccttcaccatctcctccctccagcccgaggacatcgccacctactactgccagcagggcaacaccctcccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16159 - RNA, 1353 nt, synthetic construct
  misc_feature 1..1353: note = derived and/or modified sequence opt2 from Tosatoxumab_HeavyChain1
  source 1..1353: mol_type = other RNA
gaggtccagatggtccagtccggcgccgaggtcaagaagcccggcgagcccctcaagatctcctgcaagggctccggctacaagttcggcacccactggatcggctgggtccgccagcgccccggcaagggcctcgagtggatgggcatcatccaccccgccgactccgagaccaagtactccccctccttccagggccaggtctccttctccgccgacaagtcctccaacaccgcctacctccactggtccaccctccgcgcctccgacaccgccatgtactactgcgcccgccgctccggctcctcctcctggtacgccctcgacttctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16160 - RNA, 651 nt, synthetic construct
  misc_feature 1..651: note = derived and/or modified sequence opt2 from Tosatoxumab_LightChain1
  source 1..651: mol_type = other RNA
cagtccgtcctcacccagtccccctccgcctccggcacccccggccagcgcgtcaccatctcctgctccggcggctcctccaacatcggctccaacaccgtcaactggtaccagcagttccccggcgccgcccccaagctcctcatctacaccaacaaccagcgcccctccggcgtccccgaccgcttctccggctccaagtccggcacctccgcctccctcgccatctccggcctccagtccgaggacgaggccgactactactgcgccacctgggacgactccctcaacggcctctacgtcttcggcaccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16161 - RNA, 1341 nt, synthetic construct
  misc_feature 1..1341: note = derived and/or modified sequence opt2 from Tositumomab_HeavyChain
  source 1..1341: mol_type = other RNA
caggcctacctccagcagtccggcgccgagctcgtccgccccggcgcctccgtcaagatgtcctgcaaggcctccggctacaccttcacctcctacaacatgcactgggtcaagcagaccccccgccagggcctcgagtggatcggcgccatctaccccggcaacggcgacacctcctacaaccagaagttcaagggcaaggccaccctcaccgtcgacaagtcctcctccaccgcctacatgcagctctcctccctcacctccgaggactccgccgtctacttctgcgcccgcgtcgtctactactccaactcctactggtacttcgacgtctggggcaccggcaccaccgtcaccgtctccggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16162 - RNA, 630 nt, synthetic construct
  misc_feature 1..630: note = derived and/or modified sequence opt2 from Tositumomab_LightChain
  source 1..630: mol_type = other RNA
cagatcgtcctctcccagtcccccgccatcctctccgcctcccccggcgagaaggtcaccatgacctgccgcgcctcctcctccgtctcctacatgcactggtaccagcagaagcccggctcctcccccaagccctggatctacgccccctccaacctcgcctccggcgtccccgcccgcttctccggctccggctccggcacctcctactccctcaccatctcccgcgtcgaggccgaggacgccgccacctactactgccagcagtggtccttcaacccccccaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 16163 - RNA, 1338 nt, synthetic construct
  misc_feature 1..1338: note = derived and/or modified sequence opt2 from Tovetumab_HeavyChain1
  source 1..1338: mol_type = other RNA
caggtccagctcgtcgagtccggcggcggcctcgtcaagcccggcggctccctccgcctctcctgcgccgcctccggcttcaccttctccgactactacatgaactggatccgccaggcccccggcaagggcctcgagtgggtctcctacatctcctcctccggctccatcatctactacgccgactccgtcaagggccgcttcaccatctcccgcgacaacgccaagaactccctctacctccagatgaactccctccgcgccgaggacaccgccgtctactactgcgcccgcgagggccgcatcgccgcccgcggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16164 - RNA, 645 nt, synthetic construct
  misc_feature 1..645: note = derived and/or modified sequence opt2 from Tovetumab_LightChain1
  source 1..645: mol_type = other RNA
gacatccagatgacccagtccccctcctccctctccgcctccgtcggcgaccgcgtctccatcacctgccgcccctcccagtccttctcccgctacatcaactggtaccagcagaagcccggcaaggcccccaagctcctcatccacgccgcctcctccctcgtcggcggcgtcccctcccgcttctccggctccggctccggcaccgacttcaccctcaccatctcctccctccagcccgaggacttcgccacctactactgccagcagacctactccaacccccccatcaccttcggccagggcacccgcctcgagatgaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16165 - RNA, 1347 nt, synthetic construct
  misc_feature 1..1347: note = derived and/or modified sequence opt2 from Tralokinumab_HeavyChain1
  source 1..1347: mol_type = other RNA
caggtccagctcgtccagtccggcgccgaggtcaagaagcccggcgcctccgtcaaggtctcctgcaaggcctccggctacaccttcaccaactacggcctctcctgggtccgccaggcccccggccagggcctcgagtggatgggctggatctccgccaacaacggcgacaccaactacggccaggagttccagggccgcgtcaccatgaccaccgacacctccacctccaccgcctacatggagctccgctccctccgctccgacgacaccgccgtctactactgcgcccgcgactcctcctcctcctgggcccgctggttcttcgacctctggggccgcggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16166 - RNA, 642 nt, synthetic construct
  misc_feature 1..642: note = derived and/or modified sequence opt2 from Tralokinumab_LightChain1
  source 1..642: mol_type = other RNA
tcctacgtcctcacccagcccccctccgtctccgtcgcccccggcaagaccgcccgcatcacctgcggcggcaacatcatcggctccaagctcgtccactggtaccagcagaagcccggccaggcccccgtcctcgtcatctacgacgacggcgaccgcccctccggcatccccgagcgcttctccggctccaactccggcaacaccgccaccctcaccatctcccgcgtcgaggccggcgacgaggccgactactactgccaggtctgggacaccggctccgaccccgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16167 - RNA, 1332 nt, synthetic construct
  misc_feature 1..1332: note = derived and/or modified sequence opt2 from Trastuzuab_HeavyChain1
  source 1..1332: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagaactccctccgcgccgaggacaccgccgtctactactgctcccgctggggcggcgacggcttctacgccgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggc

SEQ ID NO: 16168 - RNA, 639 nt, synthetic construct
  misc_feature 1..639: note = derived and/or modified sequence opt2 from Trastuzuab_LightChain1
  source 1..639: mol_type = other RNA
gacatccagacccagtccccctcctccctctccgcctccgtcggcgaccgcgtcaccatcacctgccgcgcctcccaggacgtcaacaccgccgtcgcctggtaccagcagaagcccggcaaggcccccaagctcctcatctactccgcctccttcctctactccggcgtcccctcccgcttctccggctcccgctccggcaccgacttcaccctcaccatctcctccctccagcccgaggacttcgccacctactactgccagcagcactacaccaccccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16169 - RNA, 1347 nt, synthetic construct
  misc_feature 1..1347: note = derived and/or modified sequence opt2 from Trastuzumab_emtansine_HeavyChain1
  source 1..1347: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16170 - RNA, 642 nt, synthetic construct; identical to SEQ ID NO: 16026
  misc_feature 1..642: note = derived and/or modified sequence opt2 from Trastuzumab_emtansine_LightChain1
  source 1..642: mol_type = other RNA

SEQ ID NO: 16171 - RNA, 1347 nt, synthetic construct; identical to SEQ ID NO: 16169
  misc_feature 1..1347: note = derived and/or modified sequence opt2 from Trastuzumab_HeavyChain1
  source 1..1347: mol_type = other RNA

SEQ ID NO: 16172 - RNA, 1353 nt, synthetic construct
  misc_feature 1..1353: note = derived and/or modified sequence opt2 from Trastuzumab_HeavyChain
  source 1..1353: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16173 - RNA, 660 nt, synthetic construct
  misc_feature 1..660: note = derived and/or modified sequence opt2 from Trastuzumab_HeavyChain_variant_1n8z_B
  source 1..660: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccc

SEQ ID NO: 16174 - RNA, 45 nt, synthetic construct
  misc_feature 1..45: note = derived and/or modified sequence opt2 from Trastuzumab_HeavyChain_variant_7637_H
  source 1..45: mol_type = other RNA
gagcccaagtcctgcgacaagacccacacctgccccccctgcccc

SEQ ID NO: 16175 - RNA, 642 nt, synthetic construct; identical to SEQ ID NO: 16026
  misc_feature 1..642: note = derived and/or modified sequence opt2 from Trastuzumab_LightChain1
  source 1..642: mol_type = other RNA

SEQ ID NO: 16176 - RNA, 642 nt, synthetic construct; identical to SEQ ID NO: 16026
  misc_feature 1..642: note = derived and/or modified sequence opt2 from Trastuzumab_LightChain_variant_1n8z_A
  source 1..642: mol_type = other RNA

SEQ ID NO: 16177 - RNA, 642 nt, synthetic construct; identical to SEQ ID NO: 16026
  misc_feature 1..642: note = derived and/or modified sequence opt2 from Trastuzumab_LightChain_variant_7637_L
  source 1..642: mol_type = other RNA

SEQ ID NO: 16178 - RNA, 1344 nt, synthetic construct
  misc_feature 1..1344: note = derived and/or modified sequence opt2 from TRC-105_HeavyChain1
  source 1..1344: mol_type = other RNA
gaggtcaagctcgaggagtccggcggcggcctcgtccagcccggcggctccatgaagctctcctgcgccgcctccggcttcaccttctccgacgcctggatggactgggtccgccagtcccccgagaagggcctcgagtgggtcgccgagatccgctccaaggcctccaaccacgccacctactacgccgagtccgtcaagggccgcttcaccatctcccgcgacgactccaagtcctccgtctacctccagatgaactccctccgcgccgaggacaccggcatctactactgcacccgctggcgccgcttcttcgactcctggggccagggcaccaccctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16179 - RNA, 639 nt, synthetic construct
  misc_feature 1..639: note = derived and/or modified sequence opt2 from TRC-105_LightChain1
  source 1..639: mol_type = other RNA
cagatcgtcctctcccagtcccccgccatcctctccgcctcccccggcgagaaggtcaccatgacctgccgcgcctcctcctccgtctcctacatgcactggtaccagcagaagcccggctcctcccccaagccctggatctacgccacctccaacctcgcctccggcgtccccgtccgcttctccggctccggctccggcacctcctactccctcaccatctcccgcgtcgaggccgaggacgccgccacctactactgccagcagtggtcctccaaccccctcaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16180 - RNA, 1362 nt, synthetic construct
  misc_feature 1..1362: note = derived and/or modified sequence opt2 from Tregalizumab_HeavyChain1
  source 1..1362: mol_type = other RNA
gaggagcagctcgtcgagtccggcggcggcctcgtcaagcccggcggctccctccgcctctcctgcgccgcctccggcttctccttctccgactgccgcatgtactggctccgccaggcccccggcaagggcctcgagtggatcggcgtcatctccgtcaagtccgagaactacggcgccaactacgccgagtccgtccgcggccgcttcaccatctcccgcgacgactccaagaacaccgtctacctccagatgaactccctcaagaccgaggacaccgccgtctactactgctccgcctcctactaccgctacgacgtcggcgcctggttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16181 - RNA, 654 nt, synthetic construct
  misc_feature 1..654: note = derived and/or modified sequence opt2 from Tregalizumab_LightChain1
  source 1..654: mol_type = other RNA
gacatcgtcatgacccagtcccccgactccctcgccgtctccctcggcgagcgcgccaccatcaactgccgcgcctccaagtccgtctccacctccggctactcctacatctactggtaccagcagaagcccggccagccccccaagctcctcatctacctcgcctccatcctcgagtccggcgtccccgaccgcttctccggctccggctccggcaccgacttcaccctcaccatctcctccctccaggccgaggacgtcgccgtctactactgccagcactcccgcgagctcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16182 - RNA, 1353 nt, synthetic construct
  misc_feature 1..1353: note = derived and/or modified sequence opt2 from Tremelimumab_HeavyChain1
  source 1..1353: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctggtacgacggctccaacaagtactacgccgactccgtcaagggccgcttcaccatctcccgcgacaactccaagaacaccctctacctccagatgaactccctccgcgccgaggacaccgccgtctactactgcgcccgcgacccccgcggcgccaccctctactactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16183 - RNA, 642 nt, synthetic construct
  misc_feature 1..642: note = derived and/or modified sequence opt2 from Tremelimumab_LightChain1
  source 1..642: mol_type = other RNA
gacatccagatgacccagtccccctcctccctctccgcctccgtcggcgaccgcgtcaccatcacctgccgcgcctcccagtccatcaactcctacctcgactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagtactactccacccccttcaccttcggccccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16184 - RNA, 1341 nt, synthetic construct
  misc_feature 1..1341: note = derived and/or modified sequence opt2 from Trevogrumab_HeavyChain1
  source 1..1341: mol_type = other RNA
gaggtccaggtcctcgagtccggcggcgacctcgtccagcccggcggctccctccgcctctcctgcgccgcctccggcttcaccttctccgcctacgccatgacctgggtccgccaggcccccggcaagggcctcgagtgggtctccgccatctccggctccggcggctccgcctactacgccgactccgtcaagggccgcttcaccatctcccgcgacaactccaagaacaccgtctacctccagatgaactccctccgcgccgaggacaccgccgtctactactgcgccaaggacggcgcctggaagatgtccggcctcgacgtctggggccagggcaccaccgtcatcgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16185 - RNA, 642 nt, synthetic construct
  misc_feature 1..642: note = derived and/or modified sequence opt2 from Trevogrumab_LightChain1
  source 1..642: mol_type = other RNA
gacatccagatgacccagtcccccgcctccctctccgcctccgtcggcgaccgcgtcaccatcacctgccgcgcctcccaggacatctccgactacctcgcctggtaccagcagaagcccggcaagatcccccgcctcctcatctacaccacctccaccctccagtccggcgtcccctcccgcttccgcggctccggctccggcaccgacttcaccctcaccatctcctccctccagcccgaggacgtcgccacctactactgccagaagtacgactccgcccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16186 - RNA, 1737 nt, synthetic construct
  misc_feature 1..1737: note = derived and/or modified sequence opt2 from Tucotuzumab_celmoleukin_HeavyChain1
  source 1..1737: mol_type = other RNA
cagatccagctcgtccagtccggcgccgaggtcaagaagcccggcgagaccgtcaagatctcctgcaaggcctccggctacaccttcaccaactacggcatgaactgggtcaagcagacccccggcaagggcctcaagtggatgggctggatcaacacctacaccggcgagcccacctacgccgacgacttcaagggccgcttcgccttctccctcgagacctccacctccaccgccttcctccagatcaacaacctccgctccgaggacaccgccacctacttctgcgtccgcttcatctccaagggcgactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaaggcccccacctcctcctccaccaagaagacccagctccagctcgagcacctcctcctcgacctccagatgatcctcaacggcatcaacaactacaagaaccccaagctcacccgcatgctcaccttcaagttctacatgcccaagaaggccaccgagctcaagcacctccagtgcctcgaggaggagctcaagcccctcgaggaggtcctcaacctcgcccagtccaagaacttccacctccgcccccgcgacctcatctccaacatcaacgtcatcgtcctcgagctcaagggctccgagaccaccttcatgtgcgagtacgccgacgagaccgccaccatcgtcgagttcctcaaccgctggatcaccttctgccagtccatcatctccaccctcacc

SEQ ID NO: 16187 - RNA, 639 nt, synthetic construct
  misc_feature 1..639: note = derived and/or modified sequence opt2 from Tucotuzumab_celmoleukin_LightChain1
  source 1..639: mol_type = other RNA
gagatcgtcctcacccagtcccccgccaccctctccctctcccccggcgagcgcgtcaccctcacctgctccgcctcctcctccgtctcctacatgctctggtaccagcagaagcccggctcctcccccaagccctggatcttcgacacctccaacctcgcctccggcttccccgcccgcttctccggctccggctccggcacctcctactccctcatcatctcctccatggaggccgaggacgccgccacctactactgccaccagcgctccggctacccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16188 - RNA, 1344 nt, synthetic construct
  misc_feature 1..1344: note = derived and/or modified sequence opt2 from Ublituximab_HeavyChain1
  source 1..1344: mol_type = other RNA
caggcctacctccagcagtccggcgccgagctcgtccgccccggcgcctccgtcaagatgtcctgcaaggcctccggctacaccttcacctcctacaacatgcactgggtcaagcagaccccccgccagggcctcgagtggatcggcggcatctaccccggcaacggcgacacctcctacaaccagaagttcaagggcaaggccaccctcaccgtcggcaagtcctcctccaccgcctacatgcagctctcctccctcacctccgaggactccgccgtctacttctgcgcccgctacgactacaactacgccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16189 - RNA, 639 nt, synthetic construct
  misc_feature 1..639: note = derived and/or modified sequence opt2 from Ublituximab_LightChain1
  source 1..639: mol_type = other RNA
cagatcgtcctctcccagtcccccgccatcctctccgcctcccccggcgagaaggtcaccatgacctgccgcgcctcctcctccgtctcctacatgcactggtaccagcagaagcccggctcctcccccaagccctggatctacgccacctccaacctcgcctccggcgtccccgcccgcttctccggctccggctccggcacctcctactccttcaccatctcccgcgtcgaggccgaggacgccgccacctactactgccagcagtggaccttcaacccccccaccttcggcggcggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16190 - RNA, 1353 nt, synthetic construct
  misc_feature 1..1353: note = derived and/or modified sequence opt2 from Ulocuplumab_HeavyChain1
  source 1..1353: mol_type = other RNA
gaggtccagctcgtcgagtccggcggcggcctcgtccagcccggcggctccctccgcctctcctgcgccgccgccggcttcaccttctcctcctactccatgaactgggtccgccaggcccccggcaagggcctcgagtgggtctcctacatctcctcccgctcccgcaccatctactacgccgactccgtcaagggccgcttcaccatctcccgcgacaacgccaagaactccctctacctccagatgaactccctccgcgacgaggacaccgccgtctactactgcgcccgcgactacggcggccagcccccctactactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 16191 - RNA, 642 nt, synthetic construct
  misc_feature 1..642: note = derived and/or modified sequence opt2 from Ulocuplumab_LightChain1
  source 1..642: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgtcacctactactgccagcagtacaactcctacccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16192 - RNA, 1344 nt, synthetic construct
  misc_feature 1..1344: note = derived and/or modified sequence opt2 from Urelumab_HeavyChain1
  source 1..1344: mol_type = other RNA
caggtccagctccagcagtggggcgccggcctcctcaagccctccgagaccctctccctcacctgcgccgtctacggcggctccttctccggctactactggtcctggatccgccagtcccccgagaagggcctcgagtggatcggcgagatcaaccacggcggctacgtcacctacaacccctccctcgagtcccgcgtcaccatctccgtcgacacctccaagaaccagttctccctcaagctctcctccgtcaccgccgccgacaccgccgtctactactgcgcccgcgactacggccccggcaactacgactggtacttcgacctctggggccgcggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16193 - RNA, 648 nt, synthetic construct
  misc_feature 1..648: note = derived and/or modified sequence opt2 from Urelumab_LightChain1
  source 1..648: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggccccccgccctcaccttctgcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16194 - RNA, 1347 nt, synthetic construct
  misc_feature 1..1347: note = derived and/or modified sequence opt2 from Urtoxazumab_HeavyChain1
  source 1..1347: mol_type = other RNA
gaggtccagctcgtcgagtccggcggcggcctcgtccagcccggcggctccctccgcctctcctgcgccgcctccggcttcaccttctcctcctacggcatgtcctgggtccgccaggcccccggcaagggcctcgagtgggtcgccaccatctccaccggcggctcctacacctactaccccgactccgtcaagggccgcttcaccatctcccgcgacaacgccaagaacaccctctacctccagatgaactccctccgcgccgaggacaccgccgtctactactgcgcccgccgcggcgacgcctggggcaacctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16195 - RNA, 642 nt, synthetic construct
  misc_feature 1..642: note = derived and/or modified sequence opt2 from Urtoxazumab_LightChain1
  source 1..642: mol_type = other RNA
gagatcgtcctcacccagtcccccgccaccctctccgtctcccccggcgagcgcgccaccctctcctgccgcgcctcccagaccatctccaacaacctccactggtaccagcagaagcccggccaggccccccgcctcctcatcaagtccgcctcccagtccatctccggcatccccgcccgcttctccggctccggctccggcaccgacttcaccctcaccatctcctccctcgagtccgaggacttcgccgtctactactgccagcagtcctactcctggcccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16196 - RNA, 1347 nt, synthetic construct
  misc_feature 1..1347: note = derived and/or modified sequence opt2 from Ustekinumab_HeavyChain1
  source 1..1347: mol_type = other RNA
gaggtccagctcgtccagtccggcgccgaggtcaagaagcccggcgagtccctcaagatctcctgcaagggctccggctactccttcaccacctactggctcggctgggtccgccagatgcccggcaagggcctcgactggatcggcatcatgtcccccgtcgactccgacatccgctactccccctccttccagggccaggtcaccatgtccgtcgacaagtccatcaccaccgcctacctccagtggaactccctcaaggcctccgacaccgccatgtactactgcgcccgccgccgccccggccagggctacttcgacttctggggccagggcaccctcgtcaccgtctcctcctcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16197 - RNA, 642 nt, synthetic construct
  misc_feature 1..642: note = derived and/or modified sequence opt2 from Ustekinumab_LightChain1
  source 1..642: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaacatctacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16198 - RNA, 1341 nt, synthetic construct
  misc_feature 1..1341: note = derived and/or modified sequence opt2 from Vadastuximab_talirine_HeavyChain1
  source 1..1341: mol_type = other RNA
caggtccagctcgtccagtccggcgccgaggtcaagaagcccggcgcctccgtcaaggtctcctgcaaggcctccggctacaccttcaccaactacgacatcaactgggtccgccaggcccccggccagggcctcgagtggatcggctggatctaccccggcgacggctccaccaagtacaacgagaagttcaaggccaaggccaccctcaccgccgacacctccacctccaccgcctacatggagctccgctccctccgctccgacgacaccgccgtctactactgcgcctccggctacgaggacgccatggactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctgcgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16199 - RNA, 642 nt, synthetic construct
  misc_feature 1..642: note = derived and/or modified sequence opt2 from Vadastuximab_talirine_LightChain1
  source 1..642: mol_type = other RNA
gacatccagatgacccagtccccctcctccctctccgcctccgtcggcgaccgcgtcaccatcaactgcaaggcctcccaggacatcaactcctacctctcctggttccagcagaagcccggcaaggcccccaagaccctcatctaccgcgccaaccgcctcgtcgacggcgtcccctcccgcttctccggctccggctccggccaggactacaccctcaccatctcctccctccagcccgaggacttcgccacctactactgcctccagtacgacgagttccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16200 - RNA, 1362 nt, synthetic construct
  misc_feature 1..1362: note = derived and/or modified sequence opt2 from Vandortuzumab_vedotin_HeavyChain1
  source 1..1362: mol_type = other RNA
gaggtccagctcgtcgagtccggcggcggcctcgtccagcccggcggctccctccgcctctcctgcgccgtctccggctactccatcacctccgactacgcctggaactgggtccgccaggcccccggcaagggcctcgagtgggtcggctacatctccaactccggctccacctcctacaacccctccctcaagtcccgcttcaccatctcccgcgacacctccaagaacaccctctacctccagatgaactccctccgcgccgaggacaccgccgtctactactgcgcccgcgagcgcaactacgactacgacgactactactacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16201 - RNA, 660 nt, synthetic construct
  misc_feature 1..660: note = derived and/or modified sequence opt2 from Vandortuzumab_vedotin_LightChain1
  source 1..660: mol_type = other RNA
gacatccagatgacccagtccccctcctccctctccgcctccgtcggcgaccgcgtcaccatcacctgcaagtcctcccagtccctcctctaccgctccaaccagaagaactacctcgcctggtaccagcagaagcccggcaaggcccccaagctcctcatctactgggcctccacccgcgagtccggcgtcccctcccgcttctccggctccggctccggcaccgacttcaccctcaccatctcctccctccagcccgaggacttcgccacctactactgccagcagtactacaactacccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16202 - RNA, 1329 nt, synthetic construct
  misc_feature 1..1329: note = derived and/or modified sequence opt2 from Vantictumab_HeavyChain1
  source 1..1329: mol_type = other RNA
gaggtccagctcgtcgagtccggcggcggcctcgtccagcccggcggctccctccgcctctcctgcgccgcctccggcttcaccttctcccactacaccctctcctgggtccgccaggcccccggcaagggcctcgagtgggtctccgtcatctccggcgacggctcctacacctactacgccgactccgtcaagggccgcttcaccatctcctccgacaactccaagaacaccctctacctccagatgaactccctccgcgccgaggacaccgccgtctactactgcgcccgcaacttcatcaagtacgtcttcgccaactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16203 - RNA, 639 nt, synthetic construct
  misc_feature 1..639: note = derived and/or modified sequence opt2 from Vantictumab_LightChain1
  source 1..639: mol_type = other RNA
gacatcgagctcacccagcccccctccgtctccgtcgcccccggccagaccgcccgcatctcctgctccggcgacaacatcggctccttctacgtccactggtaccagcagaagcccggccaggcccccgtcctcgtcatctacgacaagtccaaccgcccctccggcatccccgagcgcttctccggctccaactccggcaacaccgccaccctcaccatctccggcacccaggccgaggacgaggccgactactactgccagtcctacgccaacaccctctccctcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16204 - RNA, 1389 nt, synthetic construct
  misc_feature 1..1389: note = derived and/or modified sequence opt2 from Vanucizumab_HeavyChain1
  source 1..1389: mol_type = other RNA
caggtccagctcgtccagtccggcgccgaggtcaagaagcccggcgcctccgtcaaggtctcctgcaaggcctccggctacaccttcaccggctactacatgcactgggtccgccaggcccccggccagggcctcgagtggatgggctggatcaaccccaactccggcggcaccaactacgcccagaagttccagggccgcgtcaccatgacccgcgacacctccatctccaccgcctacatggagctctcccgcctccgctccgacgacaccgccgtctactactgcgcccgctcccccaacccctactactacgactcctccggctactactaccccggcgccttcgacatctggggccagggcaccatggtcaccgtctcctccgcctccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctgcaccctccccccctcccgcgacgagctcaccaagaaccaggtctccctctcctgcgccgtcaagggcttctacccctccgacatcgccgtcgagtgggagtccaacggccagcccgagaacaactacaagaccaccccccccgtcctcgactccgacggctccttcttcctcgtctccaagctcaccgtcgacaagtcccgctggcagcagggcaacgtcttctcctgctccgtcatgcacgaggccctccacaaccactacacccagaagtccctctccctctcccccggcaag

SEQ ID NO: 16205 - RNA, 1359 nt, synthetic construct
  misc_feature 1..1359: note = derived and/or modified sequence opt2 from Vanucizumab_HeavyChain2
  source 1..1359: mol_type = other RNA
gaggtccagctcgtcgagtccggcggcggcctcgtccagcccggcggctccctccgcctctcctgcgccgcctccggctacaccttcaccaactacggcatgaactgggtccgccaggcccccggcaagggcctcgagtgggtcggctggatcaacacctacaccggcgagcccacctacgccgccgacttcaagcgccgcttcaccttctccctcgacacctccaagtccaccgcctacctccagatgaactccctccgcgccgaggacaccgccgtctactactgcgccaagtacccccactactacggctcctcccactggtacttcgacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctgccgcgacgagctcaccaagaaccaggtctccctctggtgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16206 - RNA, 639 nt, synthetic construct
  misc_feature 1..639: note = derived and/or modified sequence opt2 from Vanucizumab_LightChain1
  source 1..639: mol_type = other RNA
cagcccggcctcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccactacgtcttcggcaccggcaccaaggtcaccgtcctctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16207 - RNA, 642 nt, synthetic construct; identical to SEQ ID NO: 15368
  misc_feature 1..642: note = derived and/or modified sequence opt2 from Vanucizumab_LightChain2
  source 1..642: mol_type = other RNA

SEQ ID NO: 16208 - RNA, 1356 nt, synthetic construct
  misc_feature 1..1356: note = derived and/or modified sequence opt2 from Varlilumab_HeavyChain1
  source 1..1356: mol_type = other RNA
caggtccagctcgtcgagtccggcggcggcgtcgtccagcccggccgctccctccgcctctcctgcgccgcctccggcttcaccttctcctcctacgacatgcactgggtccgccaggcccccggcaagggcctcgagtgggtcgccgtcatctggtacgacggctccaacaagtactacgccgactccgtcaagggccgcttcaccatctcccgcgacaactccaagaacaccctctacctccagatgaactccctccgcgccgaggacaccgccgtctactactgcgcccgcggctccggcaactggggcttcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagggctcctcc

SEQ ID NO: 16209 - RNA, 642 nt, synthetic construct
  misc_feature 1..642: note = derived and/or modified sequence opt2 from Varlilumab_LightChain1
  source 1..642: mol_type = other RNA
gacatccagatgacccagtccccctcctccctctccgcctccgtcggcgaccgcgtcaccatcacctgccgcgcctcccagggcatctcccgctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaacacctacccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16210 - RNA, 1338 nt, synthetic construct
  misc_feature 1..1338: note = derived and/or modified sequence opt2 from Vatelizumab_HeavyChain1
  source 1..1338: mol_type = other RNA
caggtccagctccaggagtccggccccggcctcgtcaagccctccgagaccctctccctcacctgcaccgtctccggcttctccctcaccaactacggcatccactggatccgccagccccccggcaagggcctcgagtggctcggcgtcatctgggcccgcggcttcaccaactacaactccgccctcatgtcccgcctcaccatctccaaggacaactccaagaaccaggtctccctcaagctctcctccgtcaccgccgccgacaccgccgtctactactgcgcccgcgccaacgacggcgtctactacgccatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16211 - RNA, 639 nt, synthetic construct
  misc_feature 1..639: note = derived and/or modified sequence opt2 from Vatelizumab_LightChain1
  source 1..639: mol_type = other RNA
gacttcgtcatgacccagtcccccgccttcctctccgtcacccccggcgagaaggtcaccatcacctgctccgcccagtcctccgtcaactacatccactggtaccagcagaagcccgaccaggcccccaagaagctcatctacgacacctccaagctcgcctccggcgtcccctcccgcttctccggctccggctccggcaccgactacaccttcaccatctcctccctcgaggccgaggacgccgccacctactactgccagcagtggaccaccaaccccctcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16212 - RNA, 1353 nt, synthetic construct
  misc_feature 1..1353: note = derived and/or modified sequence opt2 from Vedolizumab_HeavyChain1
  source 1..1353: mol_type = other RNA
caggtccagctcgtccagtccggcgccgaggtcaagaagcccggcgcctccgtcaaggtctcctgcaagggctccggctacaccttcacctcctactggatgcactgggtccgccaggcccccggccagcgcctcgagtggatcggcgagatcgacccctccgagtccaacaccaactacaaccagaagttcaagggccgcgtcaccctcaccgtcgacatctccgcctccaccgcctacatggagctctcctccctccgctccgaggacaccgccgtctactactgcgcccgcggcggctacgacggctgggactacgccatcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16213 - RNA, 657 nt, synthetic construct
  misc_feature 1..657: note = derived and/or modified sequence opt2 from Vedolizumab_LightChain1
  source 1..657: mol_type = other RNA
gacgtcgtcatgacccagtcccccctctccctccccgtcacccccggcgagcccgcctccatctcctgccgctcctcccagtccctcgccaagtcctacggcaacacctacctctcctggtacctccagaagcccggccagtccccccagctcctcatctacggcatctccaaccgcttctccggcgtccccgaccgcttctccggctccggctccggcaccgacttcaccctcaagatctcccgcgtcgaggccgaggacgtcggcgtctactactgcctccagggcacccaccagccctacaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16214 - RNA, 1353 nt, synthetic construct
  misc_feature 1..1353: note = derived and/or modified sequence opt2 from Veltuzumab_HeavyChain1
  source 1..1353: mol_type = other RNA
caggtccagctccagcagtccggcgccgaggtcaagaagcccggctcctccgtcaaggtctcctgcaaggcctccggctacaccttcacctcctacaacatgcactgggtcaagcaggcccccggccagggcctcgagtggatcggcgccatctaccccggcatgggcgacacctcctacaaccagaagttcaagggcaaggccaccctcaccgccgacgagtccaccaacaccgcctacatggagctctcctccctccgctccgaggacaccgccttctactactgcgcccgctccacctactacggcggcgactggtacttcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16215 - RNA, 639 nt, synthetic construct
  misc_feature 1..639: note = derived and/or modified sequence opt2 from Veltuzumab_LightChain1
  source 1..639: mol_type = other RNA
gacatccagctcacccagtccccctcctccctctccgcctccgtcggcgaccgcgtcaccatgacctgccgcgcctcctcctccgtctcctacatccactggttccagcagaagcccggcaaggcccccaagccctggatctacgccacctccaacctcgcctccggcgtccccgtccgcttctccggctccggctccggcaccgactacaccttcaccatctcctccctccagcccgaggacatcgccacctactactgccagcagtggacctccaacccccccaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16216 - RNA, 1359 nt, synthetic construct
  misc_feature 1..1359: note = derived and/or modified sequence opt2 from Vesencumab_HeavyChain1
  source 1..1359: mol_type = other RNA
gaggtccagctcgtcgagtccggcggcggcctcgtccagcccggcggctccctccgcctctcctgcgccgcctccggcttcaccttctcctcctacgccatgtcctgggtccgccaggcccccggcaagggcctcgagtgggtctcccagatctcccccgccggcggctacaccaactacgccgactccgtcaagggccgcttcaccatctccgccgacacctccaagaacaccgcctacctccagatgaactccctccgcgccgaggacaccgccgtctactactgcgcccgcggcgagctcccctactaccgcatgtccaaggtcatggacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16217 - RNA, 642 nt, synthetic construct
  misc_feature 1..642: note = derived and/or modified sequence opt2 from Vesencumab_LightChain1
  source 1..642: mol_type = other RNA
gacatccagatgacccagtccccctcctccctctccgcctccgtcggcgaccgcgtcaccatcacctgccgcgcctcccagtacttctcctcctacctcgcctggtaccagcagaagcccggcaaggcccccaagctcctcatctacggcgcctcctcccgcgcctccggcgtcccctcccgcttctccggctccggctccggcaccgacttcaccctcaccatctcctccctccagcccgaggacttcgccacctactactgccagcagtacctcggctccccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16218 - RNA, 1338 nt, synthetic construct
  misc_feature 1..1338: note = derived and/or modified sequence opt2 from Visilizumab_HeavyChain1
  source 1..1338: mol_type = other RNA
caggtccagctcgtccagtccggcgccgaggtcaagaagcccggcgcctccgtcaaggtctcctgcaaggcctccggctacaccttcatctcctacaccatgcactgggtccgccaggcccccggccagggcctcgagtggatgggctacatcaacccccgctccggctacacccactacaaccagaagctcaaggacaaggccaccctcaccgccgacaagtccgcctccaccgcctacatggagctctcctccctccgctccgaggacaccgccgtctactactgcgcccgctccgcctactacgactacgacggcttcgcctactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgccgccgccccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctccccctccaag

SEQ ID NO: 16219 - RNA, 639 nt, synthetic construct
  misc_feature 1..639: note = derived and/or modified sequence opt2 from Visilizumab_LightChain1
  source 1..639: mol_type = other RNA
gacatccagatgacccagtccccctcctccctctccgcctccgtcggcgaccgcgtcaccatcacctgctccgcctcctcctccgtctcctacatgaactggtaccagcagaagcccggcaaggcccccaagcgcctcatctacgacacctccaagctcgcctccggcgtcccctcccgcttctccggctccggctccggcaccgacttcaccctcaccatctcctccctccagcccgaggacttcgccacctactactgccagcagtggtcctccaacccccccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16220 - RNA, 1353 nt, synthetic construct
  misc_feature 1..1353: note = derived and/or modified sequence opt2 from Volociximab_HeavyChain
  source 1..1353: mol_type = other RNA
caggtccagctcaaggagtccggccccggcctcgtcgccccctcccagtccctctccatcacctgcaccatctccggcttctccctcaccgactacggcgtccactgggtccgccagccccccggcaagggcctcgagtggctcgtcgtcatctggtccgacggctcctccacctacaactccgccctcaagtcccgcatgaccatccgcaaggacaactccaagtcccaggtcttcctcatcatgaactccctccagaccgacgactccgccatgtactactgcgcccgccacggcacctactacggcatgaccaccaccggcgacgccctcgactactggggccagggcacctccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16221 - RNA, 645 nt, synthetic construct
  misc_feature 1..645: note = derived and/or modified sequence opt2 from Volociximab_LightChain
  source 1..645: mol_type = other RNA
cagatcgtcctcacccagtcccccgccatcatgtccgcctccctcggcgagcgcgtcaccatgacctgcaccgcctcctcctccgtctcctccaactacctccactggtaccagcagaagcccggctccgcccccaacctctggatctactccacctccaacctcgcctccggcgtccccgcccgcttctccggctccggctccggcacctcctactccctcaccatctcctccatggaggccgaggacgccgccacctactactgccaccagtacctccgctccccccccaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16222 - RNA, 1344 nt, synthetic construct
  misc_feature 1..1344: note = derived and/or modified sequence opt2 from Vorsetuzumab_HeavyChain1
  source 1..1344: mol_type = other RNA
caggtccagctcgtccagtccggcgccgaggtcaagaagcccggcgcctccgtcaaggtctcctgcaaggcctccggctacaccttcaccaactacggcatgaactgggtccgccaggcccccggccagggcctcaagtggatgggctggatcaacacctacaccggcgagcccacctacgccgacgccttcaagggccgcgtcaccatgacccgcgacacctccatctccaccgcctacatggagctctcccgcctccgctccgacgacaccgccgtctactactgcgcccgcgactacggcgactacggcatggactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16223 - RNA, 654 nt, synthetic construct
  misc_feature 1..654: note = derived and/or modified sequence opt2 from Vorsetuzumab_LightChain1
  source 1..654: mol_type = other RNA
gacatcgtcatgacccagtcccccgactccctcgccgtctccctcggcgagcgcgccaccatcaactgccgcgcctccaagtccgtctccacctccggctactccttcatgcactggtaccagcagaagcccggccagccccccaagctcctcatctacctcgcctccaacctcgagtccggcgtccccgaccgcttctccggctccggctccggcaccgacttcaccctcaccatctcctccctccaggccgaggacgtcgccgtctactactgccagcactcccgcgaggtcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16224 - RNA, 1344 nt, synthetic construct; identical to SEQ ID NO: 16222
  misc_feature 1..1344: note = derived and/or modified sequence opt2 from Vorsetuzumab_mafodotin_HeavyChain1
  source 1..1344: mol_type = other RNA

SEQ ID NO: 16225 - RNA, 654 nt, synthetic construct; identical to SEQ ID NO: 16223
  misc_feature 1..654: note = derived and/or modified sequence opt2 from Vorsetuzumab_mafodotin_LightChain1
  source 1..654: mol_type = other RNA

SEQ ID NO: 16226 - RNA, 1347 nt, synthetic construct; identical to SEQ ID NO: 15448
  misc_feature 1..1347: note = derived and/or modified sequence opt2 from Yttrium_(90Y)_clivatuzumab_tetraxetan_HeavyChain1
  source 1..1347: mol_type = other RNA

SEQ ID NO: 16227 - RNA, 645 nt, synthetic construct; identical to SEQ ID NO: 15449
  misc_feature 1..645: note = derived and/or modified sequence opt2 from Yttrium_(90Y)_clivatuzumab_tetraxetan_LightChain1
  source 1..645: mol_type = other RNA

SEQ ID NO: 16228 - RNA, 1338 nt, synthetic construct
  misc_feature 1..1338: note = derived and/or modified sequence opt2 from Yttrium_Y_90_epratuzumab_tetraxetan_HeavyChain1
  source 1..1338: mol_type = other RNA
caggtccagctcgtccagtccggcgccgaggtcaagaagcccggctcctccgtcaaggtctcctgcaaggcctccggctacaccttcacctcctactggctccactgggtccgccaggcccccggccagggcctcgagtggatcggctacatcaacccccgcaacgactacaccgagtacaaccagaacttcaaggacaaggccaccatcaccgccgacgagtccaccaacaccgcctacatggagctctcctccctccgctccgaggacaccgccttctacttctgcgcccgccgcgacatcaccaccttctactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16229 - RNA, 657 nt, synthetic construct
  misc_feature 1..657: note = derived and/or modified sequence opt2 from Yttrium_Y_90_epratuzumab_tetraxetan_LightChain1
  source 1..657: mol_type = other RNA
gacatccagctcacccagtccccctcctccctctccgcctccgtcggcgaccgcgtcaccatgtcctgcaagtcctcccagtccgtcctctactccgccaaccacaagaactacctcgcctggtaccagcagaagcccggcaaggcccccaagctcctcatctactgggcctccacccgcgagtccggcgtcccctcccgcttctccggctccggctccggcaccgacttcaccttcaccatctcctccctccagcccgaggacatcgccacctactactgccaccagtacctctcctcctggaccttcggcggcggcaccaaggtccagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16230 - RNA, 1326 nt, synthetic construct
  misc_feature 1..1326: note = derived and/or modified sequence opt2 from Yttrium_Y_90_epratuzumab_HeavyChain1
  source 1..1326: mol_type = other RNA
caggtccagctcgtccagtccggcgccgaggtcaagaagcccggctcctccgtcaaggtctcctgcaaggcctccggctacaccttcacctcctactggctccactgggtccgccaggcccccggccagggcctcgagtggatcggctacatcaacccccgcaacgactacaccgagtacaaccagaacttcaaggacaaggccaccatcaccgccgacgagtccaccaacaccgcctacgagctctcctccctccgctccgaggacaccgccttctacttctgcgcccgccgcgacatcaccaccttctactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtccacgaggccctccacaaccactacacccagaagtccctctccctctcccccggcaag

SEQ ID NO: 16231 - RNA, 654 nt, synthetic construct
  misc_feature 1..654: note = derived and/or modified sequence opt2 from Yttrium_Y_90_epratuzumab_LightChain1
  source 1..654: mol_type = other RNA
gacatccagctcacccagtccccctcctccctctccgcctccgtcggcgaccgcgtcacctcctgcaagtcctcccagtccgtcctctactccgccaaccacaagaactacctcgcctggtaccagcagaagcccggcaaggcccccaagctcctcatctactgggcctccacccgcgagtccggcgtcccctcccgcttctccggctccggctccggcaccgacttcaccttcaccatctcctccctccagcccgaggacatcgccacctactactgccaccagtacctctcctcctggaccttcggcggcggcaccaaggtccagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16232 - RNA, 1365 nt, synthetic construct
  misc_feature 1..1365: note = derived and/or modified sequence opt2 from Zalutumumab_HeavyChain1
  source 1..1365: mol_type = other RNA
caggtccagctcgtcgagtccggcggcggcgtcgtccagcccggccgctccctccgcctctcctgcgccgcctccggcttcaccttctccacctacggcatgcactgggtccgccaggcccccggcaagggcctcgagtgggtcgccgtcatctgggacgacggctcctacaagtactacggcgactccgtcaagggccgcttcaccatctcccgcgacaactccaagaacaccctctacctccagatgaactccctccgcgccgaggacaccgccgtctactactgcgcccgcgacggcatcaccatggtccgcggcgtcatgaaggactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16233 - RNA, 642 nt, synthetic construct
  misc_feature 1..642: note = derived and/or modified sequence opt2 from Zalutumumab_LightChain1
  source 1..642: mol_type = other RNA
gccatccagctcacccagtccccctcctccctctccgcctccgtcggcgaccgcgtcaccatcacctgccgcgcctcccaggacatctcctccgccctcgtctggtaccagcagaagcccggcaaggcccccaagctcctcatctacgacgcctcctccctcgagtccggcgtcccctcccgcttctccggctccgagtccggcaccgacttcaccctcaccatctcctccctccagcccgaggacttcgccacctactactgccagcagttcaactcctaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16234 - RNA, 1332 nt, synthetic construct
  misc_feature 1..1332: note = derived and/or modified sequence opt2 from Zanolimumab_H0_HeavyChain
  source 1..1332: mol_type = other RNA
caggtccagctccagcagtggggcgccggcctcctcaagccctccgagaccctctccctcacctgcgccgtctacggcggctccttctccggctactactggtcctggatccgccagccccccggcaagggcctcgagtggatcggcgagatcaaccactccggctccaccaactacaacccctccctcaagtcccgcgtcaccatctccgtcgacacctccaagaaccagttctccctcaagctctcctccgtcaccgccgccgacaccgccgtctactactgcgcccgcgtcatcaactggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctcctggaccgtcccctcctcctccctcggcacccagacctacatctgcaacgtcaacttcatcaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtctgggacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16235 - RNA, 642 nt, synthetic construct
  misc_feature 1..642: note = derived and/or modified sequence opt2 from Zanolimumab_L0_LightChain
  source 1..642: mol_type = other RNA
gacatccagatgacccagtccccctcctccgtctccgcctccgtcggcgaccgcgtcaccatcacctgccgcgcctcccaggacatctcctcctggctcgccgtcgtctaccagcacaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcaggccaactccttcccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagttcaaccgcggcgagtgc

SEQ ID NO: 16236 - RNA, 1344 nt, synthetic construct; identical to SEQ ID NO: 15855
  misc_feature 1..1344: note = derived and/or modified sequence opt2 from Zatuximab_HeavyChain1
  source 1..1344: mol_type = other RNA

SEQ ID NO: 16237 - RNA, 657 nt, synthetic construct; identical to SEQ ID NO: 15856
  misc_feature 1..657: note = derived and/or modified sequence opt2 from Zatuximab_LightChain1
  source 1..657: mol_type = other RNA

SEQ ID NO: 16238 - RNA, 1356 nt, synthetic construct
  misc_feature 1..1356: note = derived and/or modified sequence opt2 from Actoxumab_HeavyChain
  source 1..1356: mol_type = other RNA
caggtccagctcgtcgagtccggcggcggcgtcgtccagcccggccgctccctccgcctctcctgcgccgcctccggcttctccttctccaactacggcatgcactgggtccgccaggcccccggcaagggcctcgagtgggtcgccctcatctggtacgacggctccaacgaggactacaccgactccgtcaagggccgcttcaccatctcccgcgacaactccaagaacaccctctacctccagatgaactccctccgcgccgaggacaccgccgtctactactgcgcccgctggggcatggtccgcggcgtcatcgacgtcttcgacatctggggccagggcaccgtcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16239 - RNA, 642 nt, synthetic construct
  misc_feature 1..642: note = derived and/or modified sequence opt2 from Actoxumab_LightChain
  source 1..642: mol_type = other RNA
gacatccagatgacccagtccccctcctccgtctccgcctccgtcggcgaccgcgtcaccatcacctgccgcgcctcccagggcatctcctcctggctcgcctggtaccagcacaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcaggccaactccttcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16240 - RNA, 1326 nt, synthetic construct
  misc_feature 1..1326: note = derived and/or modified sequence opt2 from Andecaliximab_HeavyChain
  source 1..1326: mol_type = other RNA
caggtccagctccaggagtccggccccggcctcgtcaagccctccgagaccctctccctcacctgcaccgtctccggcttctccctcctctcctacggcgtccactgggtccgccagccccccggcaagggcctcgagtggctcggcgtcatctggaccggcggcaccaccaactacaactccgccctcatgtcccgcttcaccatctccaaggacgactccaagaacaccgtctacctcaagatgaactccctcaagaccgaggacaccgccatctactactgcgcccgctactactacggcatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16241 - RNA, 642 nt, synthetic construct
  misc_feature 1..642: note = derived and/or modified sequence opt2 from Andecaliximab_LightChain
  source 1..642: mol_type = other RNA
gacatccagatgacccagtccccctcctccctctccgcctccgtcggcgaccgcgtcaccatcacctgcaaggcctcccaggacgtccgcaacaccgtcgcctggtaccagcagaagcccggcaaggcccccaagctcctcatctactcctcctcctaccgcaacaccggcgtccccgaccgcttctccggctccggctccggcaccgacttcaccctcaccatctcctccctccaggccgaggacgtcgccgtctactactgccagcagcactacatcaccccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16242 - RNA, 1353 nt, synthetic construct
  misc_feature 1..1353: note = derived and/or modified sequence opt2 from Aprutumab_HeavyChain
  source 1..1353: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtctccgccatctccggctccggcacctccacctactacgccgactccgtcaagggccgcttcaccatctcccgcgacaactccaagaacaccctctacctccagatgaactccctccgcgccgaggacaccgccgtctactactgcgcccgcgtccgctacaactggaaccacggcgactggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16243 - RNA, 648 nt, synthetic construct
  misc_feature 1..648: note = derived and/or modified sequence opt2 from Aprutumab_LightChain
  source 1..648: mol_type = other RNA
cagtccgtcctcacccagcccccctccgcctccggcacccccggccagcgcgtcaccatctcctgctccggctcctcctccaacatcggcaacaactacgtctcctggtaccagcagctccccggcaccgcccccaagctcctcatctacgagaactacaaccgccccgccggcgtccccgaccgcttctccggctccaagtccggcacctccgcctccctcgccatctccggcctccgctccgaggacgaggccgactactactgctcctcctgggacgactccctcaactactgggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16244 - RNA, 1341 nt, synthetic construct
  misc_feature 1..1341: note = derived and/or modified sequence opt2 from Azintuxizumab_HeavyChain
  source 1..1341: mol_type = other RNA
gaggtccagctcgtcgagtccggcggcggcctcgtccagcccggcggctccctccgcctctcctgcgccgcctccggcttcaccttctccgactactacatggcctgggtccgccaggcccccggcaagggcctcgagtgggtcgcctccatcaactacgacggctcctccacctactacgtcgactccgtcaagggccgcttcaccatctcccgcgacaacgccaagaactccctctacctccagatgaactccctccgcgccgaggacaccgccgtctactactgcgcccgcgaccgcggctactacttcgactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16245 - RNA, 660 nt, synthetic construct
  misc_feature 1..660: note = derived and/or modified sequence opt2 from Azintuxizumab_LightChain
  source 1..660: mol_type = other RNA
gacgtcgtcatgacccagacccccctctccctctccgtcacccccggccagcccgcctccatctcctgccgctcctcccagtccctcgtccactccaacggcaacacctacctccactggtacctccagaagcccggccagtccccccagctcctcatctacaaggtctccaaccgcttctccggcgtccccgaccgcttctccggctccggctccggcaccgacttcaccctcaagatctcccgcgtcgaggccgaggacgtcggcgtctacttctgctcccagtccacccacgtcccccccttcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16246 - RNA, 366 nt, synthetic construct
  misc_feature 1..366: note = derived and/or modified sequence opt2 from Blinatumomab_HeavyChain1
  source 1..366: mol_type = other RNA
caggtccagctccagcagtccggcgccgagctcgtccgccccggctcctccgtcaagatctcctgcaaggcctccggctacgccttctcctcctactggatgaactgggtcaagcagcgccccggccagggcctcgagtggatcggccagatctggcccggcgacggcgacaccaactacaacggcaagttcaagggcaaggccaccctcaccgccgacgagtcctcctccaccgcctacatgcagctctcctccctcgcctccgaggactccgccgtctacttctgcgcccgccgcgagaccaccaccgtcggccgctactactacgccatggactactggggccagggcaccaccgtcaccgtc

SEQ ID NO: 16247 - RNA, 363 nt, synthetic construct
  misc_feature 1..363: note = derived and/or modified sequence opt2 from Blinatumomab_HeavyChain2
  source 1..363: mol_type = other RNA
gacatcaagctccagcagtccggcgccgagctcgcccgccccggcgcctccgtcaagatgtcctgcaagacctccggctacaccttcacccgctacaccatgcactgggtcaagcagcgccccggccagggcctcgagtggatcggctacatcaacccctcccgcggctacaccaactacaaccagaagttcaaggacaaggccaccctcaccaccgacaagtcctcctccaccgcctacatgcagctctcctccctcacctccgaggactccgccgtctactactgcgcccgctactacgacgaccactactgcctcgactactggggccagggcaccaccctcaccgtctcctccgtcgag

SEQ ID NO: 16248 - RNA, 1494 nt, synthetic construct
  misc_feature 1..1494: note = derived and/or modified sequence opt2 from Blinatumomab_LightChain_HeavyChain_HeavyChain_LightChain
  source 1..1494: mol_type = other RNA
gacatccagctcacccagtcccccgcctccctcgccgtctccctcggccagcgcgccaccatctcctgcaaggcctcccagtccgtcgactacgacggcgactcctacctcaactggtaccagcagatccccggccagccccccaagctcctcatctacgacgcctccaacctcgtctccggcatccccccccgcttctccggctccggctccggcaccgacttcaccctcaacatccaccccgtcgagaaggtcgacgccgccacctaccactgccagcagtccaccgaggacccctggaccttcggcggcggcaccaagctcgagatcaagggcggcggcggctccggcggcggcggctccggcggcggcggctcccaggtccagctccagcagtccggcgccgagctcgtccgccccggctcctccgtcaagatctcctgcaaggcctccggctacgccttctcctcctactggatgaactgggtcaagcagcgccccggccagggcctcgagtggatcggccagatctggcccggcgacggcgacaccaactacaacggcaagttcaagggcaaggccaccctcaccgccgacgagtcctcctccaccgcctacatgcagctctcctccctcgcctccgaggactccgccgtctacttctgcgcccgccgcgagaccaccaccgtcggccgctactactacgccatggactactggggccagggcaccaccgtcaccgtctcctccggcggcggcggctccgacatcaagctccagcagtccggcgccgagctcgcccgccccggcgcctccgtcaagatgtcctgcaagacctccggctacaccttcacccgctacaccatgcactgggtcaagcagcgccccggccagggcctcgagtggatcggctacatcaacccctcccgcggctacaccaactacaaccagaagttcaaggacaaggccaccctcaccaccgacaagtcctcctccaccgcctacatgcagctctcctccctcacctccgaggactccgccgtctactactgcgcccgctactacgacgaccactactgcctcgactactggggccagggcaccaccctcaccgtctcctccgtcgagggcggctccggcggctccggcggctccggcggctccggcggcgtcgacgacatccagctcacccagtcccccgccatcatgtccgcctcccccggcgagaaggtcaccatgacctgccgcgcctcctcctccgtctcctacatgaactggtaccagcagaagtccggcacctcccccaagcgctggatctacgacacctccaaggtcgcctccggcgtcccctaccgcttctccggctccggctccggcacctcctactccctcaccatctcctccatggaggccgaggacgccgccacctactactgccagcagtggtcctccaaccccctcaccttcggcgccggcaccaagctcgagctcaag

SEQ ID NO: 16249 - RNA, 333 nt, synthetic construct
  misc_feature 1..333: note = derived and/or modified sequence opt2 from Blinatumomab_LightChain1
  source 1..333: mol_type = other RNA
gacatccagctcacccagtcccccgcctccctcgccgtctccctcggccagcgcgccaccatctcctgcaaggcctcccagtccgtcgactacgacggcgactcctacctcaactggtaccagcagatccccggccagccccccaagctcctcatctacgacgcctccaacctcgtctccggcatccccccccgcttctccggctccggctccggcaccgacttcaccctcaacatccaccccgtcgagaaggtcgacgccgccacctaccactgccagcagtccaccgaggacccctggaccttcggcggcggcaccaagctcgagatcaag

SEQ ID NO: 16250 - RNA, 324 nt, synthetic construct
  misc_feature 1..324: note = derived and/or modified sequence opt2 from Blinatumomab_LightChain2
  source 1..324: mol_type = other RNA
gtcgacgacatccagctcacccagtcccccgccatcatgtccgcctcccccggcgagaaggtcaccatgacctgccgcgcctcctcctccgtctcctacatgaactggtaccagcagaagtccggcacctcccccaagcgctggatctacgacacctccaaggtcgcctccggcgtcccctaccgcttctccggctccggctccggcacctcctactccctcaccatctcctccatggaggccgaggacgccgccacctactactgccagcagtggtcctccaaccccctcaccttcggcgccggcaccaagctcgagctcaag

SEQ ID NO: 16251 - RNA, 1350 nt, synthetic construct
  misc_feature 1..1350: note = derived and/or modified sequence opt2 from Brazikumab_HeavyChain
  source 1..1350: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctggtacgacggctccaacgagtactacgccgactccgtcaagggccgcttcaccatctcccgcgacaactccaagaacaccctctacctccagatgaactccctccgcgccgaggacaccgccgtctactactgcgcccgcgaccgcggctacacctcctcctggtaccccgacgccttcgacatctggggccagggcaccatggtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16252 - RNA, 651 nt, synthetic construct
  misc_feature 1..651: note = derived and/or modified sequence opt2 from Brazikumab_LightChain
  source 1..651: mol_type = other RNA
cagtccgtcctcacccagcccccctccgtctccggcgcccccggccagcgcgtcaccatctcctgcaccggctcctcctccaacaccggcgccggctacgacgtccactggtaccagcaggtccccggcaccgcccccaagctcctcatctacggctccggcaaccgcccctccggcgtccccgaccgcttctccggctccaagtccggcacctccgcctccctcgccatcaccggcctccaggccgaggacgaggccgactactactgccagtcctacgactcctccctctccggctgggtcttcggcggcggcacccgcctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16253 - RNA, 363 nt, synthetic construct
  misc_feature 1..363: note = derived and/or modified sequence opt2 from Brolucizumab_HeavyChain
  source 1..363: mol_type = other RNA
tccgaggtccagctcgtcgagtccggcggcggcctcgtccagcccggcggctccctccgcctctcctgcaccgcctccggcttctccctcaccgactactactacatgacctgggtccgccaggcccccggcaagggcctcgagtgggtcggcttcatcgaccccgacgacgacccctactacgccacctgggccaagggccgcttcaccatctcccgcgacaactccaagaacaccctctacctccagatgaactccctccgcgccgaggacaccgccgtctactactgcgccggcggcgaccacaactccggctggggcctcgacatctggggccagggcaccctcgtcaccgtctcctcc

SEQ ID NO: 16254 - RNA, 333 nt, synthetic construct
  misc_feature 1..333: note = derived and/or modified sequence opt2 from Brolucizumab_LightChain
  source 1..333: mol_type = other RNA
atggagatcgtcatgacccagtccccctccaccctctccgcctccgtcggcgaccgcgtcatcatcacctgccaggcctccgagatcatccactcctggctcgcctggtaccagcagaagcccggcaaggcccccaagctcctcatctacctcgcctccaccctcgcctccggcgtcccctcccgcttctccggctccggctccggcgccgagttcaccctcaccatctcctccctccagcccgacgacttcgccacctactactgccagaacgtctacctcgcctccaccaacggcgccaacttcggccagggcaccaagctcaccgtcctc

SEQ ID NO: 16255 - RNA, 1347 nt, synthetic construct
  misc_feature 1..1347: note = derived and/or modified sequence opt2 from Cabiralizumab_HeavyChain
  source 1..1347: mol_type = other RNA
caggtccagctcgtccagtccggcgccgaggtcaagaagcccggctcctccgtcaaggtctcctgcaaggcctccggctacaccttcaccgacaactacatgatctgggtccgccaggcccccggccagggcctcgagtggatgggcgacatcaacccctacaacggcggcaccaccttcaaccagaagttcaagggccgcgtcaccatcaccgccgacaagtccacctccaccgcctacatggagctctcctccctccgctccgaggacaccgccgtctactactgcgcccgcgagtccccctacttctccaacctctacgtcatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16256 - RNA, 654 nt, synthetic construct
  misc_feature 1..654: note = derived and/or modified sequence opt2 from Cabiralizumab_LightChain
  source 1..654: mol_type = other RNA
gagatcgtcctcacccagtcccccgccaccctctccctctcccccggcgagcgcgccaccctctcctgcaaggcctcccagtccgtcgactacgacggcgacaactacatgaactggtaccagcagaagcccggccaggccccccgcctcctcatctacgccgcctccaacctcgagtccggcatccccgcccgcttctccggctccggctccggcaccgacttcaccctcaccatctcctccctcgagcccgaggacttcgccgtctactactgccacctctccaacgaggacctctccaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16257 - RNA, 1329 nt, synthetic construct
  misc_feature 1..1329: note = derived and/or modified sequence opt2 from Camrelizumab_HeavyChain
  source 1..1329: mol_type = other RNA
gaggtccagctcgtcgagtccggcggcggcctcgtccagcccggcggctccctccgcctctcctgcgccgcctccggcttcaccttctcctcctacatgatgtcctgggtccgccaggcccccggcaagggcctcgagtgggtcgccaccatctccggcggcggcgccaacacctactaccccgactccgtcaagggccgcttcaccatctcccgcgacaacgccaagaactccctctacctccagatgaactccctccgcgccgaggacaccgccgtctactactgcgcccgccagctctactacttcgactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16258 - RNA, 642 nt, synthetic construct
  misc_feature 1..642: note = derived and/or modified sequence opt2 from Camrelizumab_LightChain
  source 1..642: mol_type = other RNA
gacatccagatgacccagtccccctcctccctctccgcctccgtcggcgaccgcgtcaccatcacctgcctcgcctcccagaccatcggcacctggctcacctggtaccagcagaagcccggcaaggcccccaagctcctcatctacaccgccacctccctcgccgacggcgtcccctcccgcttctccggctccggctccggcaccgacttcaccctcaccatctcctccctccagcccgaggacttcgccacctactactgccagcaggtctactccatcccctggaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16259 - RNA, 777 nt, synthetic construct; identical to SEQ ID NO: 15426
  misc_feature 1..777: note = derived and/or modified sequence opt2 from Caplacizumab_HeavyChain
  source 1..777: mol_type = other RNA

SEQ ID NO: 16260 - RNA, 657 nt, synthetic construct
  misc_feature 1..657: note = derived and/or modified sequence opt2 from Citatuzumab_bogatox_HeavyChain
  source 1..657: mol_type = other RNA
gaggtccagctcgtccagtccggccccggcctcgtccagcccggcggctccgtccgcatctcctgcgccgcctccggctacaccttcaccaactacggcatgaactgggtcaagcaggcccccggcaagggcctcgagtggatgggctggatcaacacctacaccggcgagtccacctacgccgactccttcaagggccgcttcaccttctccctcgacacctccgcctccgccgcctacctccagatcaactccctccgcgccgaggacaccgccgtctactactgcgcccgcttcgccatcaagggcgactactggggccagggcaccctcctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16261 - RNA, 1356 nt, synthetic construct
  misc_feature 1..1356: note = derived and/or modified sequence opt2 from Cosfroviximab_HeavyChain
  source 1..1356: mol_type = other RNA
gacgtcaagctcctcgagtccggcggcggcctcgtccagcccggcggctccctcaagctctcctgcgccgcctccggcttctccctctccacctccggcgtcggcgtcggctggttccgccagccctccggcaagggcctcgagtggctcgccctcatctggtgggacgacgacaagtactacaacccctccctcaagtcccagctctccatctccaaggacttctcccgcaaccaggtcttcctcaagatctccaacgtcgacatcgccgacaccgccacctactactgcgcccgccgcgaccccttcggctacgacaacgccatgggctactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16262 - RNA, 639 nt, synthetic construct
  misc_feature 1..639: note = derived and/or modified sequence opt2 from Cosfroviximab_LightChain
  source 1..639: mol_type = other RNA
gacatcgtcatgacccagtcccccctctccctctccacctccgtcggcgaccgcgtctccctcacctgcaaggcctcccagaacgtcggcaccgccgtcgcctggtaccagcagaagcccggccagtcccccaagctcctcatctactccgcctccaaccgctacaccggcgtccccgaccgcttcaccggctccggctccggcaccgacttcaccctcaccatctccaacatgcagtccgaggacctcgccgactacttctgccagcagtactcctcctaccccctcaccttcggcgccggcaccaagctcgagctccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16263 - RNA, 1344 nt, synthetic construct
  misc_feature 1..1344: note = derived and/or modified sequence opt2 from Crizanlizumab_HeavyChain
  source 1..1344: mol_type = other RNA
caggtccagctcgtccagtccggcgccgaggtcaagaagcccggcgcctccgtcaaggtctcctgcaaggtctccggctacaccttcacctcctacgacatcaactgggtccgccaggcccccggcaagggcctcgagtggatgggctggatctaccccggcgacggctccatcaagtacaacgagaagttcaagggccgcgtcaccatgaccgtcgacaagtccaccgacaccgcctacatggagctctcctccctccgctccgaggacaccgccgtctactactgcgcccgccgcggcgagtacggcaactacgagggcgccatggactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcacctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcgccgtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16264 - RNA, 654 nt, synthetic construct
  misc_feature 1..654: note = derived and/or modified sequence opt2 from Crizanlizumab_LightChain
  source 1..654: mol_type = other RNA
gacatccagatgacccagtccccctcctccctctccgcctccgtcggcgaccgcgtcaccatcacctgcaaggcctcccagtccgtcgactacgacggccactcctacatgaactggtaccagcagaagcccggcaaggcccccaagctcctcatctacgccgcctccaacctcgagtccggcgtcccctcccgcttctccggctccggctccggcaccgacttcaccctcaccatctcctccctccagcccgaggacttcgccacctactactgccagcagtccgacgagaaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16265 - RNA, 1365 nt, synthetic construct
  misc_feature 1..1365: note = derived and/or modified sequence opt2 from Crotedumab_HeavyChain
  source 1..1365: mol_type = other RNA
gaggtccagctcgtcgagtccggcggcggcctcgtccagcccggcggctccctccgcctctcctgcgccgcctccggcttcaccttctccaactacctcatgaactgggtccgccaggcccccggcaagggcctcgagtggctcgccaacatccaggaggacggcatcgagaagtactacgtcgactccgtcaagggccgcttcaccatctcccgcgacaacgccaagaactccctctacctccagatgaactccctccgcgccgaggacaccgccgtctactactgcgcccgcgagccctcccactacgacatcctcaccggctacgactactactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16266 - RNA, 642 nt, synthetic construct
  misc_feature 1..642: note = derived and/or modified sequence opt2 from Crotedumab_LightChain
  source 1..642: mol_type = other RNA
gacatccagatgacccagtccccctcctccctctccgcctccgtcggcgaccgcgtcaccatcacctgccgcgcctcccagggcatccgcaacgacctcggctggtaccagcagaagcccggcaaggcccccaagcgcctcatctacgccgcctcctccctccagtccggcgtcccctcccgcttctccggctccggctccggcaccgagttcatcctcaccgtctcctccctccagcccgaggacttcgccacctactactgcctccagtacaactccaaccccttcaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16267 - RNA, 1356 nt, synthetic construct
  misc_feature 1..1356: note = derived and/or modified sequence opt2 from Dezamizumab_HeavyChain
  source 1..1356: mol_type = other RNA
caggtccagctcgtccagtccggcgccgaggtcaagaagcccggctcctccgtcaaggtctcctgcaaggcctccggcttcaccttcgccacctacaacatgcactgggtccgccaggcccccggccagggcctcgagtggatgggctacatctaccccggcgacggcaacgccaactacaaccagcagttcaagggccgcgtcaccatcaccgccgacaagtccacctccaccgcctacatggagctctcctccctccgctccgaggacaccgccgtctactactgcgcccgcggcgacttcgactacgacggcggctactacttcgactcctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16268 - RNA, 642 nt, synthetic construct
  misc_feature 1..642: note = derived and/or modified sequence opt2 from Dezamizumab_LightChain
  source 1..642: mol_type = other RNA
gacatccagatgacccagtccccctcctccctctccgcctccgtcggcgaccgcgtcaccatcacctgccgcgcctccgagaacatctactcctacctcgcctggtaccagcagaagcccggcaaggcccccaagctcctcatccacaacgccaagaccctcgccgagggcgtcccctcccgcttctccggctccggctccggcaccgacttcaccctcaccatctcctccctccagcccgaggacttcgccacctactactgccagcaccactacggcgcccccctcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16269 - RNA, 1506 nt, synthetic construct
  misc_feature 1..1506: note = derived and/or modified sequence opt2 from Duvortuxizumab_Chain1_scFv
  source 1..1506: mol_type = other RNA
gagaacgtcctcacccagtcccccgccaccctctccgtcacccccggcgagaaggccaccatcacctgccgcgcctcccagtccgtctcctacatgcactggtaccagcagaagcccggccaggccccccgcctcctcatctacgacgcctccaaccgcgcctccggcgtcccctcccgcttctccggctccggctccggcaccgaccacaccctcaccatctcctccctcgaggccgaggacgccgccacctactactgcttccagggctccgtctaccccttcaccttcggccagggcaccaagctcgagatcaagggcggcggctccggcggcggcggcgaggtccagctcgtcgagtccggcggcggcctcgtccagcccggcggctccctccgcctctcctgcgccgcctccggcttcaccttctccacctacgccatgaactgggtccgccaggcccccggcaagggcctcgagtgggtcggccgcatccgctccaagtacaacaactacgccacctactacgccgactccgtcaagggccgcttcaccatctcccgcgacgactccaagaactccctctacctccagatgaactccctcaagaccgaggacaccgccgtctactactgcgtccgccacggcaacttcggcaactcctacgtctcctggttcgcctactggggccagggcaccctcgtcaccgtctcctccgcctccaccaagggcgaggtcgccgcctgcgagaaggaggtcgccgccctcgagaaggaggtcgccgccctcgagaaggaggtcgccgccctcgagaagggcggcggcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctctggtgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16270 - RNA, 813 nt, synthetic construct
  misc_feature 1..813: note = derived and/or modified sequence opt2 from Duvortuxizumab_Chain2_scFv
  source 1..813: mol_type = other RNA
caggccgtcgtcacccaggagccctccctcaccgtctcccccggcggcaccgtcaccctcacctgccgctcctccaccggcgccgtcaccacctccaactacgccaactgggtccagcagaagcccggccaggccccccgcggcctcatcggcggcaccaacaagcgcgccccctggacccccgcccgcttctccggctccctcctcggcggcaaggccgccctcaccatcaccggcgcccaggccgaggacgaggccgactactactgcgccctctggtactccaacctctgggtcttcggcggcggcaccaagctcaccgtcctcggcggcggcggctccggcggcggcggccaggtcaccctccgcgagtccggccccgccctcgtcaagcccacccagaccctcaccctcacctgcaccttctccggcttctccctctccacctccggcatgggcgtcggctggatccgccagccccccggcaaggccctcgagtggctcgcccacatctggtgggacgacgacaagcgctacaaccccgccctcaagtcccgcctcaccatctccaaggacacctccaagaaccaggtcttcctcaccatgaccaacatggaccccgtcgacaccgccacctactactgcgcccgcatggagctctggtcctactacttcgactactggggccagggcaccaccgtcaccgtctcctccgcctccaccaagggcaaggtcgccgcctgcaaggagaaggtcgccgccctcaaggagaaggtcgccgccctcaaggagaaggtcgccgccctcaaggag

SEQ ID NO: 16271 - RNA, 681 nt, synthetic construct
  misc_feature 1..681: note = derived and/or modified sequence opt2 from Duvortuxizumab_Chain3_h-CH2-CH3
  source 1..681: mol_type = other RNA
gacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctctcctgcgccgtcaagggcttctacccctccgacatcgccgtcgagtgggagtccaacggccagcccgagaacaactacaagaccaccccccccgtcctcgactccgacggctccttcttcctcgtctccaagctcaccgtcgacaagtcccgctggcagcagggcaacgtcttctcctgctccgtcatgcacgaggccctccacaaccgctacacccagaagtccctctccctctcccccggcaag

SEQ ID NO: 16272 - RNA, 360 nt, synthetic construct
  misc_feature 1..360: note = derived and/or modified sequence opt2 from Efungumab_HeavyChain
  source 1..360: mol_type = other RNA
atggccgaggtccagctcgtcgagtccggcgccgaggtcaagaagcccggcgagtccctccgcatctcctgcaagggctccggctgcatcatctcctcctactggatctcctgggtccgccagatgcccggcaagggcctcgagtggatgggcaagatcgaccccggcgactcctacatcaactactccccctccttccagggccacgtcaccatctccgccgacaagtccatcaacaccgcctacctccagtggaactccctcaaggcctccgacaccgccatgtactactgcgcccgcggcggccgcgacttcggcgactccttcgactactggggccagggcaccctcgtcaccgtc

SEQ ID NO: 16273 - RNA, 750 nt, synthetic construct
  misc_feature 1..750: note = derived and/or modified sequence opt2 from Efungumab_HeavyChain_LightChain
  source 1..750: mol_type = other RNA
atggccgaggtccagctcgtcgagtccggcgccgaggtcaagaagcccggcgagtccctccgcatctcctgcaagggctccggctgcatcatctcctcctactggatctcctgggtccgccagatgcccggcaagggcctcgagtggatgggcaagatcgaccccggcgactcctacatcaactactccccctccttccagggccacgtcaccatctccgccgacaagtccatcaacaccgcctacctccagtggaactccctcaaggcctccgacaccgccatgtactactgcgcccgcggcggccgcgacttcggcgactccttcgactactggggccagggcaccctcgtcaccgtctcctccggcggcggcggctccggcggcggcggctccggcggcggcggctccgacgtcgtcatgacccagtccccctccttcctctccgccttcgtcggcgaccgcatcaccatcacctgccgcgcctcctccggcatctcccgctacctcgcctggtaccagcaggcccccggcaaggcccccaagctcctcatctacgccgcctccaccctccagaccggcgtcccctcccgcttctccggctccggctccggcaccgagttcaccctcaccatcaactccctccagcccgaggacttcgccacctactactgccagcacctcaactcctaccccctcaccttcggcggcggcaccaaggtcgacatcaagcgcgccgccgccctcgag

SEQ ID NO: 16274 - RNA, 339 nt, synthetic construct
  misc_feature 1..339: note = derived and/or modified sequence opt2 from Efungumab_LightChain
  source 1..339: mol_type = other RNA
gacgtcgtcatgacccagtccccctccttcctctccgccttcgtcggcgaccgcatcaccatcacctgccgcgcctcctccggcatctcccgctacctcgcctggtaccagcaggcccccggcaaggcccccaagctcctcatctacgccgcctccaccctccagaccggcgtcccctcccgcttctccggctccggctccggcaccgagttcaccctcaccatcaactccctccagcccgaggacttcgccacctactactgccagcacctcaactcctaccccctcaccttcggcggcggcaccaaggtcgacatcaagcgcgccgccgccctcgag

SEQ ID NO: 16275 - RNA, 1350 nt, synthetic construct
  misc_feature 1..1350: note = derived and/or modified sequence opt2 from Elezanumab_HeavyChain
  source 1..1350: mol_type = other RNA
gaggtccagctcgtccagtccggcgccgaggtcaagaagcccggcgcctccgtcaaggtctcctgcaaggcctccggctacaccttcacctcccacggcatctcctgggtccgccaggcccccggccagggcctcgactggatgggctggatctccccctactccggcaacaccaactacgcccagaagctccagggccgcgtcaccatgaccaccgacacctccacctccaccgcctacatggagctctcctccctccgctccgaggacaccgccgtctactactgcgcccgcgtcggctccggcccctactactacatggacgtctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcggcccctccgtcttcctcttcccccccaagcccaaggaccagctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcctccacgaggccctccacaaccactacacccagaagtccctctccctctcccccggcaag

SEQ ID NO: 16276 - RNA, 645 nt, synthetic construct
  misc_feature 1..645: note = derived and/or modified sequence opt2 from Elezanumab_LightChain
  source 1..645: mol_type = other RNA
cagtccgccctcacccagccccgctccgtctccggctcccccggccagtccgtcaccatctcctgcaccggcacctcctcctccgtcggcgactccatctacgtctcctggtaccagcagcaccccggcaaggcccccaagctcatgctctacgacgtcaccaagcgcccctccggcgtccccgaccgcttctccggctccaagtccggcaacaccgcctccctcaccatctccggcctccaggccgaggacgaggccgactactactgctactcctacgccggcaccgacaccctcttcggcggcggcaccaaggtcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16277 - RNA, 1359 nt, synthetic construct
  misc_feature 1..1359: note = derived and/or modified sequence opt2 from Emapalumab_HeavyChain
  source 1..1359: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtctccgccatctccggctccggcggctccacctactacgccgactccgtcaagggccgcttcaccatctcccgcgacaactccaagaacaccctctacctccagatgaactccctccgcgccgaggacaccgccgtctactactgcgccaaggacggctcctccggctggtacgtcccccactggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16278 - RNA, 651 nt, synthetic construct
  misc_feature 1..651: note = derived and/or modified sequence opt2 from Emapalumab_LightChain
  source 1..651: mol_type = other RNA
aacttcatgctcacccagccccactccgtctccgagtcccccggcaagaccgtcaccatctcctgcacccgctcctccggctccatcgcctccaactacgtccagtggtaccagcagcgccccggctcctcccccaccaccgtcatctacgaggacaaccagcgcccctccggcgtccccgaccgcttctccggctccatcgactcctcctccaactccgcctccctcaccatctccggcctcaagaccgaggacgaggccgactactactgccagtcctacgacggctccaaccgctggatgttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16279 - RNA, 1341 nt, synthetic construct
  misc_feature 1..1341: note = derived and/or modified sequence opt2 from Enoblituzumab_HeavyChain
  source 1..1341: mol_type = other RNA
caggtcgagctcgtcgagtccggcggcggcctcgtccagcccggcggctccctccgcctctcctgcgccgcctccggcttcaccttcacctcctactggatgtcctgggtccgccaggcccccggcaagggcctcgagctcgtctcctccatcacctcctacggctccttcacctactacgccgactccgtcaagggccgcttcaccatctcccgcgacaactccaagaacaccctctacctccagatgaactccctccgcgccgaggacaccgccgtctactactgcgcccgcaacatgtacacccacttcgactcctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16280 - RNA, 648 nt, synthetic construct
  misc_feature 1..648: note = derived and/or modified sequence opt2 from Enoblituzumab_LightChain
  source 1..648: mol_type = other RNA
gacatcgtcctcacccagcccccctccgtctccggcgcccccggccagcgcgtcaccatctcctgctccggctcctcctccaacatcggctccaactccgtctcctggtaccagcagctccccggcaccgcccccaagctcctcatctacgacaactccaagcgcccctccggcgtccccgaccgcttctccggctccaagtccggcacctccgcctccctcgccatcaccggcctccagtccgaggacgaggccgactactactgccagtcccgcgacacctacggctactactgggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaagggcgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16281 - RNA, 1323 nt, synthetic construct
  misc_feature 1..1323: note = derived and/or modified sequence opt2 from Eptinezumab_HeavyChain
  source 1..1323: mol_type = other RNA
gaggtccagctcgtcgagtccggcggcggcctcgtccagcccggcggctccctccgcctctcctgcgccgtctccggcatcgacctctccggctactacatgaactgggtccgccaggcccccggcaagggcctcgagtgggtcggcgtcatcggcatcaacggcgccacctactacgcctcctgggccaagggccgcttcaccatctcccgcgacaactccaagaccaccgtctacctccagatgaactccctccgcgccgaggacaccgccgtctacttctgcgcccgcggcgacatctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacgcccgcgtcgagcccaagtcctgcgacaagacccacacctgccccccctgccccgcccccgagctcctcggcggcccctccgtcaccctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16282 - RNA, 657 nt, synthetic construct
  misc_feature 1..657: note = derived and/or modified sequence opt2 from Eptinezumab_LightChain
  source 1..657: mol_type = other RNA
caggtcctcacccagtccccctcctccctctccgcctccgtcggcgaccgcgtcaccatcaactgccaggcctcccagtccgtctaccacaacacctacctcgcctggtaccagcagaagcccggcaaggtccccaagcagctcatctacgacgcctccaccctcgcctccggcgtcccctcccgcttctccggctccggctccggcaccgacttcaccctcaccatctcctccctccagcccgaggacgtcgccacctactactgcctcggctcctacgactgcaccaacggcgactgcttcgtcttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16283 - RNA, 1368 nt, synthetic construct
  misc_feature 1..1368: note = derived and/or modified sequence opt2 from Erenumab_HeavyChain
  source 1..1368: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctccttcgacggctccatcaagtactccgtcgactccgtcaagggccgcttcaccatctcccgcgacaactccaagaacaccctcttcctccagatgaactccctccgcgccgaggacaccgccgtctactactgcgcccgcgaccgcctcaactactacgactcctccggctactaccactacaagtactacggcatggccgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16284 - RNA, 648 nt, synthetic construct
  misc_feature 1..648: note = derived and/or modified sequence opt2 from Erenumab_LightChain
  source 1..648: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaacaacaagcgcccctccggcatccccgaccgcttctccggctccaagtccggcacctccaccaccctcggcatcaccggcctccagaccggcgacgaggccgactactactgcggcacctgggactcccgcctctccgccgtcgtcttcggcggcggcaccaagctcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16285 - RNA, 1344 nt, synthetic construct
  misc_feature 1..1344: note = derived and/or modified sequence opt2 from Fremanezumab_HeavyChain
  source 1..1344: mol_type = other RNA
gaggtccagctcgtcgagtccggcggcggcctcgtccagcccggcggctccctccgcctctcctgcgccgcctccggcttcaccttctccaactactggatctcctgggtccgccaggcccccggcaagggcctcgagtgggtcgccgagatccgctccgagtccgacgcctccgccacccactacgccgaggccgtcaagggccgcttcaccatctcccgcgacaacgccaagaactccctctacctccagatgaactccctccgcgccgaggacaccgccgtctactactgcctcgcctacttcgactacggcctcgccatccagaactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16286 - RNA, 642 nt, synthetic construct
  misc_feature 1..642: note = derived and/or modified sequence opt2 from Fremanezumab_LightChain
  source 1..642: mol_type = other RNA
gagatcgtcctcacccagtcccccgccaccctctccctctcccccggcgagcgcgccaccctctcctgcaaggcctccaagcgcgtcaccacctacgtctcctggtaccagcagaagcccggccaggccccccgcctcctcatctacggcgcctccaaccgctacctcggcatccccgcccgcttctccggctccggctccggcaccgacttcaccctcaccatctcctccctcgagcccgaggacttcgccgtctactactgctcccagtcctacaactacccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16287 - RNA, 1371 nt, synthetic construct
  misc_feature 1..1371: note = derived and/or modified sequence opt2 from Frunevetmab_HeavyChain
  source 1..1371: mol_type = other RNA
caggtccagctcgtcgagtccggcgccgagctcgtccagcccggcgagtccctccgcctcacctgcgccgcctccggcttctccctcaccaacaacaacgtcaactgggtccgccaggcccccggcaagggcctcgagtggatgggcggcgtctgggccggcggcgccaccgactacaactccgccctcaagtcccgcctcaccatcacccgcgacacctccaagaacaccgtcttcctccagatgcactccctccagtccgaggacaccgccacctactactgcgcccgcgacggcggctactcctcctccaccctctacgccatggacgcctggggccagggcaccaccgtcaccgtctccgccgcctccaccaccgccccctccgtcttccccctcgccccctcctgcggcaccacctccggcgccaccgtcgccctcgcctgcctcgtcctcggctacttccccgagcccgtcaccgtctcctggaactccggcgccctcacctccggcgtccacaccttccccgccgtcctccaggcctccggcctctactccctctcctccatggtcaccgtcccctcctcccgctggctctccgacaccttcacctgcaacgtcgcccaccccccctccaacaccaaggtcgacaagaccgtccgcaagaccgaccacccccccggccccaagccctgcgactgccccaagtgccccccccccgagatgctcggcggcccctccatcttcatcttcccccccaagcccaaggacaccctctccatctcccgcacccccgaggtcacctgcctcgtcgtcgacctcggccccgacgactccgacgtccagatcacctggttcgtcgacaacacccaggtctacaccgccaagacctccccccgcgaggagcagttcaactccacctaccgcgtcgtctccgtcctccccatcctccaccaggactggctcaagggcaaggagttcaagtgcaaggtcaactccaagtccctcccctcccccatcgagcgcaccatctccaaggccaagggccagccccacgagccccaggtctacgtcctcccccccgcccaggaggagctctcccgcaacaaggtctccgtcacctgcctcatcaagtccttccacccccccgacatcgccgtcgagtgggagatcaccggccagcccgagcccgagaacaactaccgcaccacccccccccagctcgactccgacggcacctacttcgtctactccaagctctccgtcgaccgctcccactggcagcgcggcaacacctacacctgctccgtctcccacgaggccctccactcccaccacacccagaagtccctcacccagtcccccggcaag

SEQ ID NO: 16288 - RNA, 651 nt, synthetic construct
  misc_feature 1..651: note = derived and/or modified sequence opt2 from Frunevetmab_LightChain
  source 1..651: mol_type = other RNA
gacatcgagatgacccagtcccccctctccctctccgtcacccccggcgagtccgtctccatctcctgccgcgcctccgaggacatctacaacgccctcgcctggtacctccagaagcccggccgctccccccgcctcctcatctacaacaccgacaccctccacaccggcgtccccgaccgcttctccggctccggctccggcaccgacttcaccctcaagatctcccgcgtccagaccgaggacgtcggcgtctacttctgccagcactacttccactacccccgcaccttcggccagggcaccaagctcgagctcaagcgctccgacgcccagccctccgtcttcctcttccagccctccctcgacgagctccacaccggctccgcctccatcgtctgcatcctcaacgacttctaccccaaggaggtcaacgtcaagtggaaggtcgacggcgtcgtccagaacaagggcatccaggagtccaccaccgagcagaactccaaggactccacctactccctctcctccaccctcaccatgtcctccaccgagtaccagtcccacgagaagttctcctgcgaggtcacccacaagtccctcgcctccaccctcgtcaagtccttcaaccgctccgagtgccagcgcgag

SEQ ID NO: 16289 - RNA, 1341 nt, synthetic construct
  misc_feature 1..1341: note = derived and/or modified sequence opt2 from Gatipotuzumab_HeavyChain
  source 1..1341: mol_type = other RNA
gaggtccagctcgtcgagtccggcggcggcctcgtccagcccggcggctccatgcgcctctcctgcgtcgcctccggcttccccttctccaactactggatgaactgggtccgccaggcccccggcaagggcctcgagtgggtcggcgagatccgcctcaagtccaacaactacaccacccactacgccgagtccgtcaagggccgcttcaccatctcccgcgacgactccaagaactccctctacctccagatgaactccctcaagaccgaggacaccgccgtctactactgcacccgccactactacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 16290 - RNA, 657 nt, synthetic construct
  misc_feature 1..657: note = derived and/or modified sequence opt2 from Gatipotuzumab_LightChain
  source 1..657: mol_type = other RNA
gacatcgtcatgacccagtcccccctctccaaccccgtcacccccggcgagcccgcctccatctcctgccgctcctccaagtccctcctccactccaacggcatcacctacttcttctggtacctccagaagcccggccagtccccccagctcctcatctaccagatgtccaacctcgcctccggcgtccccgaccgcttctccggctccggctccggcaccgacttcaccctccgcatctcccgcgtcgaggccgaggacgtcggcgtctactactgcgcccagaacctcgagctcccccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16291 - RNA, 1365 nt, synthetic construct
  misc_feature 1..1365: note = derived and/or modified sequence opt2 from Gedivumab_HeavyChain
  source 1..1365: mol_type = other RNA
gaggtccagctcgtcgagtccggcggcggcgtcgtccagcccggcaagtccctccgcctctcctgcgccgcctccggcctcaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16292 - RNA, 648 nt, synthetic construct
  misc_feature 1..648: note = derived and/or modified sequence opt2 from Gedivumab_LightChain
  source 1..648: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactggcccccccgcctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16293 - RNA, 1329 nt, synthetic construct
  misc_feature 1..1329: note = derived and/or modified sequence opt2 from Gemetuzumab_HeavyChain
  source 1..1329: mol_type = other RNA
gaggtccagctcgtccagtccggcgccgaggtcaagaagcccggctcctccgtcaaggtctcctgcaaggcctccggctacaccatcaccgactccaacatccactgggtccgccaggcccccggccagtccctcgagtggatcggctacatctacccctacaacggcggcaccgactacaaccagaagttcaagaaccgcgccaccctcaccgtcgacaaccccaccaacaccgcctacatggagctctcctccctccgctccgaggacaccgccttctactactgcgtcaacggcaacccctggctcgcctactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16294 - RNA, 654 nt, synthetic construct
  misc_feature 1..654: note = derived and/or modified sequence opt2 from Gemetuzumab_LightChain
  source 1..654: mol_type = other RNA
gacatccagctcacccagtccccctccaccctctccgcctccgtcggcgaccgcgtcaccatcacctgccgcgcctccgagtccctcgacaactacggcatccgcttcctcacctggttccagcagaagcccggcaaggcccccaagctcctcatgtacgccgcctccaaccagggctccggcgtcccctcccgcttctccggctccggctccggcaccgagttcaccctcaccatctcctccctccagcccgacgacttcgccacctactactgccagcagaccaaggaggtcccctggtccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16295 - RNA, 1365 nt, synthetic construct
  misc_feature 1..1365: note = derived and/or modified sequence opt2 from Gilvetmab_HeavyChain
  source 1..1365: mol_type = other RNA
gaggtccagctcgtccagtccggcggcgacctcgtcaagcccggcggctccgtccgcctctcctgcgtcgcctccggcttcaacatcaagaacacctacatgcactgggtccgccaggcccccggcaagggcctccagtggatcggccgcatcgcccccgccaacgtcgacaccaagtacgcccccaagttccagggcaaggccaccatctccgccgacaccgccaagaacaccgcctacatgcagctcaactccctccgcgccgaggacaccgccgtctactactgcgtcctcatctactacgactacgacggcgacatcgacgtctggggccagggcaccctcgtcaccgtctcctccgcctccaccaccgccccctccgtcttccccctcgccccctcctgcggctccacctccggctccaccgtcgccctcgcctgcctcgtctccggctacttccccgagcccgtcaccgtctcctggaactccggctccctcacctccggcgtccacaccttcccctccgtcctccagtcctccggcctctactccctctcctccatggtcaccgtcccctcctcccgctggccctccgagaccttcacctgcaacgtcgcccaccccgcctccaagaccaaggtcgacaagcccgtccccaagcgcgagaacggccgcgtcccccgcccccccgactgccccaagtgccccgcccccgagatgctcggcggcccctccgtcttcatcttcccccccaagcccaaggacaccctcctcatcgcccgcacccccgaggtcacctgcgtcgtcgtcgccctcgaccccgaggaccccgaggtccagatctcctggttcgtcgacggcaagcagatgcagaccgccaagacccagccccgcgaggagcagttcgccggcacctaccgcgtcgtctccgtcctccccatcggccaccaggactggctcaagggcaagcagttcacctgcaaggtcaacaacaaggccctcccctcccccatcgagcgcaccatctccaaggcccgcggccaggcccaccagccctccgtctacgtcctccccccctcccgcgaggagctctccaagaacaccgtctccctcacctgcctcatcaaggacttcttcccccccgacatcgacgtcgagtggcagtccaacggccagcaggagcccgagtccaagtaccgcaccacccccccccagctcgacgaggacggctcctacttcctctactccaagctctccgtcgacaagtcccgctggcagcgcggcgacaccttcatctgcgccgtcatgcacgaggccctccacaaccactacacccaggagtccctctcccactcccccggcaag

SEQ ID NO: 16296 - RNA, 654 nt, synthetic construct
  misc_feature 1..654: note = derived and/or modified sequence opt2 from Gilvetmab_LightChain
  source 1..654: mol_type = other RNA
gacatcgtcatgacccagacccccctctccctctccgtctccctcggcgagcccgcctccatctcctgccacgcctcccagaacatcaacgtctggctctcctggtaccgccagaagcccggccagatcccccagctcctcatctacaaggcctcccacctccacaccggcgtccccgaccgcttctccggctccggctccggcaccgacttcaccctccgcatctcccgcgtcgaggccgacgacgccggcgtctactactgccagcagggccagtcctggcccctcaccttcggccagggcaccaaggtcgagatcaagcgcaacgacgcccagcccgccgtctacctcttccagccctcccccgaccagctccacaccggctccgcctccgtcgtctgcctcctcaactccttctaccccaaggacatcaacgtcaagtggaaggtcgacggcgtcatccaggacaccggcatccaggagtccgtcaccgagcaggactccaaggactccacctactccctctcctccaccctcaccatgtcctccaccgagtacctctcccacgagctctactcctgcgagatcacccacaagtccctcccctccaccctcatcaagtccttccagcgctccgagtgccagcgcgtcgac

SEQ ID NO: 16297 - RNA, 1344 nt, synthetic construct; identical to SEQ ID NO: 15580
  misc_feature 1..1344: note = derived and/or modified sequence opt2 from Ifabotuzumab_HeavyChain
  source 1..1344: mol_type = other RNA

SEQ ID NO: 16298 - RNA, 642 nt, synthetic construct; identical to SEQ ID NO: 15581
  misc_feature 1..642: note = derived and/or modified sequence opt2 from Ifabotuzumab_LightChain
  source 1..642: mol_type = other RNA

SEQ ID NO: 16299 - RNA, 1323 nt, synthetic construct
  misc_feature 1..1323: note = derived and/or modified sequence opt2 from Iratumumab_HeavyChain
  source 1..1323: mol_type = other RNA
caggtccagctccagcagtggggcgccggcctcctcaagccctccgagaccctctccctcacctgcgccgtctacggcggctccttctccgcctactactggtcctggatccgccagccccccggcaagggcctcgagtggatcggcgacatcaaccacggcggcggcaccaactacaacccctccctcaagtcccgcgtcaccatctccgtcgacacctccaagaaccagttctccctcaagctcaactccgtcaccgccgccgacaccgccgtctactactgcgcctccctcaccgcctactggggccagggctccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccacacccagaagtccctctccctctcccccggcaag

SEQ ID NO: 16300 - RNA, 642 nt, synthetic construct
  misc_feature 1..642: note = derived and/or modified sequence opt2 from Iratumumab_LightChain
  source 1..642: mol_type = other RNA
gacatccagatgacccagtcccccacctccctctccgcctccgtcggcgaccgcgtcaccatcacctgccgcgcctcccagggcatctcctcctggctcacctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacgactcctaccccatcaccttcggccagggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16301 - RNA, 1344 nt, synthetic construct
  misc_feature 1..1344: note = derived and/or modified sequence opt2 from Lacnotuzumab_HeavyChain
  source 1..1344: mol_type = other RNA
caggtccagctccaggagtccggccccggcctcgtcaagccctcccagaccctctccctcacctgcaccgtctccgactactccatcacctccgactacgcctggaactggatccgccagttccccggcaagggcctcgagtggatgggctacatctcctactccggctccacctcctacaacccctccctcaagtcccgcatcaccatctcccgcgacacctccaagaaccagttctccctccagctcaactccgtcaccgccgccgacaccgccgtctactactgcgcctccttcgactacgcccacgccatggactactggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16302 - RNA, 642 nt, synthetic construct
  misc_feature 1..642: note = derived and/or modified sequence opt2 from Lacnotuzumab_LightChain
  source 1..642: mol_type = other RNA
gacatcgtcctcacccagtcccccgccttcctctccgtcacccccggcgagaaggtcaccttcacctgccaggcctcccagtccatcggcacctccatccactggtaccagcagaagaccgaccaggcccccaagctcctcatcaagtacgcctccgagtccatctccggcatcccctcccgcttctccggctccggctccggcaccgacttcaccctcaccatctcctccgtcgaggccgaggacgccgccgactactactgccagcagatcaactcctggcccaccaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16303 - RNA, 1347 nt, synthetic construct
  misc_feature 1..1347: note = derived and/or modified sequence opt2 from Larcaviximab_HeavyChain
  source 1..1347: mol_type = other RNA
gaggtccagctccaggagtccggccccgagctcgagatgcccggcgcctccgtcaagatctcctgcaaggcctccggctcctccttcaccggcttctccatgaactgggtcaagcagtccaacggcaagtccctcgagtggatcggcaacatcgacacctactacggcggcaccacctacaaccagaagttcaagggcaaggccaccctcaccgtcgacaagtcctcctccaccgcctacatgcagctcaagtccctcacctccgaggactccgccgtctactactgcgcccgctccgcctactacggctccaccttcgcctactggggccagggcaccctcgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16304 - RNA, 642 nt, synthetic construct
  misc_feature 1..642: note = derived and/or modified sequence opt2 from Larcaviximab_LightChain
  source 1..642: mol_type = other RNA
gacatccagatgacccagtcccccgcctccctctccgcctccgtcggcgagaccgtcaccatcacctgccgcgcctccgagaacatctactcctacctcgcctggtaccagcagaagcagggcaagtccccccagctcctcgtctacaacgccaagaccctcatcgagggcgtcccctcccgcttctccggctccggctccggcacccagttctccctcaagatcaactccctccagcccgaggacttcggctcctacttctgccagcaccacttcggcacccccttcaccttcggctccggcaccgagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16305 - RNA, 1338 nt, synthetic construct
  misc_feature 1..1338: note = derived and/or modified sequence opt2 from Lendalizumab_HeavyChain
  source 1..1338: mol_type = other RNA
caggtccagctcgtccagtccggcgccgaggtcaagaagcccggcgcctccgtcaaggtctcctgcaaggcctccggctacaccttcaccgactactccatggactgggtccgccaggcccccggccagggcctcgagtggatgggcgccatccacctcaacaccggctacaccaactacaaccagaagttcaagggccgcgtcaccatgacccgcgacacctccacctccaccgtctacatggagctctcctccctccgctccgaggacaccgccgtctactactgcgcccgcggcttctacgacggctactcccccatggactactggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16306 - RNA, 654 nt, synthetic construct
  misc_feature 1..654: note = derived and/or modified sequence opt2 from Lendalizumab_LightChain
  source 1..654: mol_type = other RNA
gacatccagatgacccagtccccctcctccctctccgcctccgtcggcgaccgcgtcaccatcacctgccgcgcctccgagtccgtcgactcctacggcaactccttcatgcactggtaccagcagaagcccggcaaggcccccaagctcctcatctaccgcgcctccaacctcgagtccggcgtcccctcccgcttctccggctccggctccggcaccgacttcaccctcaccatctcctccctccagcccgaggacttcgccacctactactgccagcagtccaacgaggacccctacaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16307 - RNA, 1359 nt, synthetic construct
  misc_feature 1..1359: note = derived and/or modified sequence opt2 from Lesofavumab_HeavyChain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgagtccgagaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16308 - RNA, 657 nt, synthetic construct
  misc_feature 1..657: note = derived and/or modified sequence opt2 from Lesofavumab_LightChain
  source 1..657: mol_type = other RNA
gacatcgtcatgacccagtcccccctctccctccccgtcacccccggcgagcccgcctccatctcctgccgctcctcccagtccctcctccgctccaacggctacaactacctcgactggtacctccagaagcccggccagtccccccagctcctcatctacctcggctccaaccgcgcctccggcgtccccgaccgcttctccggctccggctccggcaccgacttcaccctcaagatctcccgcgtcgaggccgaggacgtcggcgtctactactgcatgcaggccctccagaccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16309 - RNA, 1059 nt, synthetic construct
  misc_feature 1..1059: note = derived and/or modified sequence opt2 from Letolizumab_HeavyChain
  source 1..1059: mol_type = other RNA
gaggtccagctcctcgagtccggcggcggcctcgtccagcccggcggctccctccgcctctcctgcgccgcctccggcttcaccttcaactgggagctcatgggctgggcccgccaggcccccggcaagggcctcgagtgggtctccggcatcgagggccccggcgacgtcacctactacgccgactccgtcaagggccgcttcaccatctcccgcgacaactccaagaacaccctctacctccagatgaactccctccgcgccgaggacaccgccgtctactactgcgtcaaggtcggcaaggacgccaagtccgactaccgcggccagggcaccctcgtcaccgtctcctccgcctccaccgagcccaagtcctccgacaagacccacacctcccccccctcccccgcccccgagctcctcggcggctcctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16310 - RNA, 1338 nt, synthetic construct
  misc_feature 1..1338: note = derived and/or modified sequence opt2 from Losatuxizumab_HeavyChain
  source 1..1338: mol_type = other RNA
gaggtccagctccaggagtccggccccggcctcgtcaagccctcccagaccctctccctcacctgcaccgtctccggctactccatctcccgcgacttcgcctggaactggatccgccagccccccggcaagggcctcgagtggatgggctacatctcctacaacggcaacacccgctaccagccctccctcaagtcccgcatcaccatctcccgcgacacctccaagaaccagttcttcctcaagctcaactccgtcaccgccgccgacaccgccacctactactgcgtcaccgcctcccgcggcttcccctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16311 - RNA, 642 nt, synthetic construct; identical to SEQ ID NO: 15489
  misc_feature 1..642: note = derived and/or modified sequence opt2 from Losatuxizumab_LightChain
  source 1..642: mol_type = other RNA

SEQ ID NO: 16312 - RNA, 1338 nt, synthetic construct
  misc_feature 1..1338: note = derived and/or modified sequence opt2 from Lupartumab_HeavyChain
  source 1..1338: mol_type = other RNA
gaggtccagctcctcgagtccggcggcggcctcgtccagcccggcggctccctccgcctctcctgcgccgcctccggcttcaccttctccaacgcctggatgtcctgggtccgccaggcccccggcaagggcctcgagtgggtctcctacatctcctcctccggctccaccatctactacgccgactccgtcaagggccgcttcaccatctcccgcgacaactccaagaacaccctctacctccagatgaactccctccgcgccgaggacaccgccgtctactactgcgcccgcgagggcctctgggccttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16313 - RNA, 651 nt, synthetic construct
  misc_feature 1..651: note = derived and/or modified sequence opt2 from Lupartumab_LightChain
  source 1..651: mol_type = other RNA
gagtccgtcctcacccagcccccctccgtctccggcgcccccggccagcgcgtcaccatctcctgcaccggctcctcctccaacatcggcgccggctacgtcgtccactggtaccagcagctccccggcaccgcccccaagctcctcatctacgacaacaacaagcgcccctccggcgtccccgaccgcttctccggctccaagtccggcacctccgcctccctcgccatctccggcctccgctccgaggacgaggccgactactactgcgccgcctgggacgaccgcctcaacggccccgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16314 - RNA, 1731 nt, synthetic construct
  misc_feature 1..1731: note = derived and/or modified sequence opt2 from Lutikizumab_HeavyChain
  source 1..1731: mol_type = other RNA
gaggtccagctcgtcgagtccggcggcggcgtcgtccagcccggccgctccctccgcctctcctgctccgcctccggcttcatcttctcccgctacgacatgtcctgggtccgccaggcccccggcaagggcctcgagtgggtcgcctacatctcccacggcggcgccggcacctactaccccgactccgtcaagggccgcttcaccatctcccgcgacaactccaagaacaccctcttcctccagatggactccctccgccccgaggacaccggcgtctacttctgcgcccgcggcggcgtcaccaagggctacttcgacgtctggggccagggcacccccgtcaccgtctcctccgcctccaccaagggcccccaggtccagctcgtcgagtccggcggcggcgtcgtccagcccggccgctccctccgcctctcctgcaccgcctccggcttcaccttctccatgttcggcgtccactgggtccgccaggcccccggcaagggcctcgagtgggtcgccgccgtctcctacgacggctccaacaagtactacgccgagtccgtcaagggccgcttcaccatctcccgcgacaactccaagaacatcctcttcctccagatggactccctccgcctcgaggacaccgccgtctactactgcgcccgcggccgccccaaggtcgtcatccccgcccccctcgcccactggggccagggcaccctcgtcaccttctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16315 - RNA, 981 nt, synthetic construct
  misc_feature 1..981: note = derived and/or modified sequence opt2 from Lutikizumab_LightChain
  source 1..981: mol_type = other RNA
gacatccagatgacccagtccccctcctccctctccgcctccgtcggcgaccgcgtcaccatcacctgccgcgcctccggcaacatccacaactacctcacctggtaccagcagacccccggcaaggcccccaagctcctcatctacaacgccaagaccctcgccgacggcgtcccctcccgcttctccggctccggctccggcaccgactacaccttcaccatctcctccctccagcccgaggacatcgccacctactactgccagcacttctggtccatcccctacaccttcggccagggcaccaagctccagatcacccgcaccgtcgccgcccccgacatccagatgacccagtccccctcctccgtctccgcctccgtcggcgaccgcgtcaccatcacctgccgcgcctcccagggcatctcctcctggctcgcctggtaccagcagaagcccggcaaggcccccaagctcctcatctacgaggcctccaacctcgagaccggcgtcccctcccgcttctccggctccggctccggctccgacttcaccctcaccatctcctccctccagcccgaggacttcgccacctactactgccagcagacctcctccttcctcctctccttcggcggcggcaccaaggtcgagcacaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16316 - RNA, 1341 nt, synthetic construct
  misc_feature 1..1341: note = derived and/or modified sequence opt2 from Oleclumab_HeavyChain
  source 1..1341: mol_type = other RNA
gaggtccagctcctcgagtccggcggcggcctcgtccagcccggcggctccctccgcctctcctgcgccgcctccggcttcaccttctcctcctacgcctactcctgggtccgccaggcccccggcaagggcctcgagtgggtctccgccatctccggctccggcggccgcacctactacgccgactccgtcaagggccgcttcaccatctcccgcgacaactccaagaacaccctctacctccagatgaactccctccgcgccgaggacaccgccgtctactactgcgcccgcctcggctacggccgcgtcgacgagtggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagttcgagggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcctccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16317 - RNA, 648 nt, synthetic construct
  misc_feature 1..648: note = derived and/or modified sequence opt2 from Oleclumab_LightChain
  source 1..648: mol_type = other RNA
cagtccgtcctcacccagcccccctccgcctccggcacccccggccagcgcgtcaccatctcctgctccggctccctctccaacatcggccgcaaccccgtcaactggtaccagcagctccccggcaccgcccccaagctcctcatctacctcgacaacctccgcctctccggcgtccccgaccgcttctccggctccaagtccggcacctccgcctccctcgccatctccggcctccagtccgaggacgaggccgactactactgcgccacctgggacgactcccaccccggctggaccttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16318 - RNA, 1449 nt, synthetic construct; identical to SEQ ID NO: 15933
  misc_feature 1..1449: note = derived and/or modified sequence opt2 from Otlertuzumab_HeavyChain
  source 1..1449: mol_type = other RNA

SEQ ID NO: 16319 - RNA, 339 nt, synthetic construct
  misc_feature 1..339: note = derived and/or modified sequence opt2 from Ozoralizumab_HeavyChain
  source 1..339: mol_type = other RNA
gaggtccagctcgtcgagtccggcggcggcctcgtccagcccggcggctccctccgcctctcctgcgccgcctccggcttcaccttctccgactactggatgtactgggtccgccaggcccccggcaagggcctcgagtgggtctccgagatcaacaccaacggcctcatcaccaagtaccccgactccgtcaagggccgcttcaccatctcccgcgacaacgccaagaacaccctctacctccagatgaactccctccgccccgaggacaccgccgtctactactgcgcccgctccccctccggcttcaaccgcggccagggcaccctcgtcaccgtc

SEQ ID NO: 16320 - RNA, 1089 nt, synthetic construct; identical to SEQ ID NO: 15938
  misc_feature 1..1089: note = derived and/or modified sequence opt2 from Ozoralizumab_HeavyChain_HeavyChain_HeavyChain
  source 1..1089: mol_type = other RNA

SEQ ID NO: 16321 - RNA, 1494 nt, synthetic construct
  misc_feature 1..1494: note = derived and/or modified sequence opt2 from Pasotuxizumab_HeavyChain_LightChain_HeavyChain_LightChain
  source 1..1494: mol_type = other RNA
caggtccagctcgtcgagtccggcggcggcctcgtcaagcccggcgagtccctccgcctctcctgcgccgcctccggcttcaccttctccgactactacatgtactgggtccgccaggcccccggcaagggcctcgagtgggtcgccatcatctccgacggcggctactacacctactactccgacatcatcaagggccgcttcaccatctcccgcgacaacgccaagaactccctctacctccagatgaactccctcaaggccgaggacaccgccgtctactactgcgcccgcggcttccccctcctccgccacggcgccatggactactggggccagggcaccctcgtcaccgtctcctccggcggcggcggctccggcggcggcggctccggcggcggcggctccgacatccagatgacccagtccccctcctccctctccgcctccgtcggcgaccgcgtcaccatcacctgcaaggcctcccagaacgtcgacaccaacgtcgcctggtaccagcagaagcccggccaggcccccaagtccctcatctactccgcctcctaccgctactccgacgtcccctcccgcttctccggctccgcctccggcaccgacttcaccctcaccatctcctccgtccagtccgaggacttcgccacctactactgccagcagtacgactcctacccctacaccttcggcggcggcaccaagctcgagatcaagtccggcggcggcggctccgaggtccagctcgtcgagtccggcggcggcctcgtccagcccggcggctccctcaagctctcctgcgccgcctccggcttcaccttcaacaagtacgccatgaactgggtccgccaggcccccggcaagggcctcgagtgggtcgcccgcatccgctccaagtacaacaactacgccacctactacgccgactccgtcaaggaccgcttcaccatctcccgcgacgactccaagaacaccgcctacctccagatgaacaacctcaagaccgaggacaccgccgtctactactgcgtccgccacggcaacttcggcaactcctacatctcctactgggcctactggggccagggcaccctcgtcaccgtctcctccggcggcggcggctccggcggcggcggctccggcggcggcggctcccagaccgtcgtcacccaggagccctccctcaccgtctcccccggcggcaccgtcaccctcacctgcggctcctccaccggcgccgtcacctccggcaactaccccaactgggtccagcagaagcccggccaggccccccgcggcctcatcggcggcaccaagttcctcgcccccggcacccccgcccgcttctccggctccctcctcggcggcaaggccgccctcaccctctccggcgtccagcccgaggacgaggccgagtactactgcgtcctctggtactccaaccgctgggtcttcggcggcggcaccaagctcaccgtcctc

SEQ ID NO: 16322 - RNA, 357 nt, synthetic construct
  misc_feature 1..357: note = derived and/or modified sequence opt2 from Pasotuxizumab_HeavyChain1
  source 1..357: mol_type = other RNA
caggtccagctcgtcgagtccggcggcggcctcgtcaagcccggcgagtccctccgcctctcctgcgccgcctccggcttcaccttctccgactactacatgtactgggtccgccaggcccccggcaagggcctcgagtgggtcgccatcatctccgacggcggctactacacctactactccgacatcatcaagggccgcttcaccatctcccgcgacaacgccaagaactccctctacctccagatgaactccctcaaggccgaggacaccgccgtctactactgcgcccgcggcttccccctcctccgccacggcgccatggactactggggccagggcaccctcgtcaccgtc

SEQ ID NO: 16323 - RNA, 369 nt, synthetic construct
  misc_feature 1..369: note = derived and/or modified sequence opt2 from Pasotuxizumab_HeavyChain2
  source 1..369: mol_type = other RNA
gaggtccagctcgtcgagtccggcggcggcctcgtccagcccggcggctccctcaagctctcctgcgccgcctccggcttcaccttcaacaagtacgccatgaactgggtccgccaggcccccggcaagggcctcgagtgggtcgcccgcatccgctccaagtacaacaactacgccacctactacgccgactccgtcaaggaccgcttcaccatctcccgcgacgactccaagaacaccgcctacctccagatgaacaacctcaagaccgaggacaccgccgtctactactgcgtccgccacggcaacttcggcaactcctacatctcctactgggcctactggggccagggcaccctcgtcaccgtc

SEQ ID NO: 16324 - RNA, 321 nt, synthetic construct
  misc_feature 1..321: note = derived and/or modified sequence opt2 from Pasotuxizumab_LightChain1
  source 1..321: mol_type = other RNA
gacatccagatgacccagtccccctcctccctctccgcctccgtcggcgaccgcgtcaccatcacctgcaaggcctcccagaacgtcgacaccaacgtcgcctggtaccagcagaagcccggccaggcccccaagtccctcatctactccgcctcctaccgctactccgacgtcccctcccgcttctccggctccgcctccggcaccgacttcaccctcaccatctcctccgtccagtccgaggacttcgccacctactactgccagcagtacgactcctacccctacaccttcggcggcggcaccaagctcgagatcaag

SEQ ID NO: 16325 - RNA, 327 nt, synthetic construct
  misc_feature 1..327: note = derived and/or modified sequence opt2 from Pasotuxizumab_LightChain2
  source 1..327: mol_type = other RNA
cagaccgtcgtcacccaggagccctccctcaccgtctcccccggcggcaccgtcaccctcacctgcggctcctccaccggcgccgtcacctccggcaactaccccaactgggtccagcagaagcccggccaggccccccgcggcctcatcggcggcaccaagttcctcgcccccggcacccccgcccgcttctccggctccctcctcggcggcaaggccgccctcaccctctccggcgtccagcccgaggacgaggccgagtactactgcgtcctctggtactccaaccgctgggtcttcggcggcggcaccaagctcaccgtcctc

SEQ ID NO: 16326 - RNA, 1023 nt, synthetic construct; identical to SEQ ID NO: 15982
  misc_feature 1..1023: note = derived and/or modified sequence opt2 from Placulumab_HeavyChain
  source 1..1023: mol_type = other RNA

SEQ ID NO: 16327 - RNA, 1353 nt, synthetic construct
  misc_feature 1..1353: note = derived and/or modified sequence opt2 from Porgaviximab_HeavyChain
  source 1..1353: mol_type = other RNA
gaggtccagctccaggagtccggcggcggcctcatgcagcccggcggctccatgaagctctcctgcgtcgcctccggcttcaccttctccaactactggatgaactgggtccgccagtcccccgagaagggcctcgagtgggtcgccgagatccgcctcaagtccaacaactacgccacccactacgccgagtccgtcaagggccgcttcaccatctcccgcgacgactccaagcgctccgtctacctccagatgaacaccctccgcgccgaggacaccggcatctactactgcacccgcggcaacggcaactaccgcgccatggactactggggccagggcacctccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16328 - RNA, 642 nt, synthetic construct
  misc_feature 1..642: note = derived and/or modified sequence opt2 from Porgaviximab_LightChain
  source 1..642: mol_type = other RNA
gacatccagatgacccagtcccccgcctccctctccgtctccgtcggcgagaccgtctccatcacctgccgcgcctccgagaacatctactcctccctcgcctggtaccagcagaagcagggcaagtccccccagctcctcgtctactccgccaccatcctcgccgacggcgtcccctcccgcttctccggctccggctccggcacccagtactccctcaagatcaactccctccagtccgaggacttcggcacctactactgccagcacttctggggcaccccctacaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16329 - RNA, 1341 nt, synthetic construct
  misc_feature 1..1341: note = derived and/or modified sequence opt2 from Prezalumab_HeavyChain
  source 1..1341: mol_type = other RNA
gaggtccagctcgtcgagtccggcggcggcctcgtccagcccggcggctccctccgcctctcctgcgccgcctccggcttcaccttctcctcctactggatgtcctgggtccgccaggcccccggcaagggcctcgagtgggtcgcctacatcaagcaggacggcaacgagaagtactacgtcgactccgtcaagggccgcttcaccatctcccgcgacaacgccaagaactccctctacctccagatgaactccctccgcgccgaggacaccgccgtctactactgcgcccgcgagggcatcctctggttcggcgacctccccaccttctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16330 - RNA, 642 nt, synthetic construct
  misc_feature 1..642: note = derived and/or modified sequence opt2 from Prezalumab_LightChain
  source 1..642: mol_type = other RNA
gacatccagatgacccagtccccctcctccctctccgcctccgtcggcgaccgcgtcaccatcacctgccgcgcctcccagggcatctccaactggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacgactcctacccccgcaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16331 - RNA, 342 nt, synthetic construct
  misc_feature 1..342: note = derived and/or modified sequence opt2 from Radretumab_HeavyChain
  source 1..342: mol_type = other RNA
gaggtccagctcctcgagtccggcggcggcctcgtccagcccggcggctccctccgcctctcctgcgccgcctccggcttcaccttctcctccttctccatgtcctgggtccgccaggcccccggcaagggcctcgagtgggtctcctccatctccggctcctccggcaccacctactacgccgactccgtcaagggccgcttcaccatctcccgcgacaactccaagaacaccctctacctccagatgaactccctccgcgccgaggacaccgccgtctactactgcgccaagcccttcccctacttcgactactggggccagggcaccctcgtcaccgtc

SEQ ID NO: 16332 - RNA, 1071 nt, synthetic construct; identical to SEQ ID NO: 16001
  misc_feature 1..1071: note = derived and/or modified sequence opt2 from Radretumab_HeavyChain_LightChain
  source 1..1071: mol_type = other RNA

SEQ ID NO: 16333 - RNA, 693 nt, synthetic construct
  misc_feature 1..693: note = derived and/or modified sequence opt2 from Radretumab_LightChain
  source 1..693: mol_type = other RNA
gcctccgagatcgtcctcacccagtcccccggcaccctctccctctcccccggcgagcgcgccaccctctcctgccgcgcctcccagtccgtctcctcctccttcctcgcctggtaccagcagaagcccggccaggccccccgcctcctcatctactacgcctcctcccgcgccaccggcatccccgaccgcttctccggctccggctccggcaccgacttcaccctcaccatctcccgcctcgagcccgaggacttcgccgtctactactgccagcagaccggccgcatcccccccaccttcggccagggcaccaaggtcgagatcaagtccggcggctccggcggcccccgcgccgcccccgaggtctacgccttcgccacccccgagtggcccggctcccgcgacaagcgcaccctcgcctgcctcatccagaacttcatgcccgaggacatctccgtccagtggctccacaacgaggtccagctccccgacgcccgccactccaccacccagccccgcaagaccaagggctccggcttcttcgtcttctcccgcctcgaggtcacccgcgccgagtgggagcagaaggacgagttcatctgccgcgccgtccacgaggccgcctccccctcccagaccgtccagcgcgccgtctccgtcaaccccgagtcctcccgccgcggcggctgc

SEQ ID NO: 16334 - RNA, 1359 nt, synthetic construct
  misc_feature 1..1359: note = derived and/or modified sequence opt2 from Ranevetmab_HeavyChain1
  source 1..1359: mol_type = other RNA
gaggtccagctcgtcgagtccggcggcggcctcgtccagcccggcggctccctccgcctctcctgcgtcgcctccggcttctccctcaccaacaacaacgtcaactgggtccgccaggcccccggcaagggcctcgagtgggtcggcggcgtctgggccggcggcgccaccgactacaactccgccctcaagtcccgcttcaccatctcccgcgacaacgccaagaacaccgtcttcctccagatgcactccctccgctccgaggacaccgccgtctactactgcgcccgcgacggcggctactcctcctccaccctctacgccatggacgcctggggccagggcacctccgtcaccgtctcctccgcctccaccaccgccccctccgtcttccccctcgccccctcctgcggctccacctccggctccaccgtcgccctcgcctgcctcgtctccggctacttccccgagcccgtcaccgtctcctggaactccggctccctcacctccggcgtccacaccttcccctccgtcctccagtcctccggcctccactccctctcctccatggtcaccgtcccctcctcccgctggccctccgagaccttcacctgcaacgtcgtccaccccgcctccaacaccaaggtcgacaagcccgtcttcaacgagtgccgctgcaccgacacccccccctgccccgtccccgagcccctcggcggcccctccgtcctcatcttcccccccaagcccaaggacatcctccgcatcacccgcacccccgaggtcacctgcgtcgtcctcgacctcggccgcgaggaccccgaggtccagatctcctggttcgtcgacggcaaggaggtcatcaccgccaagacccagtcccgcgagcagcagttcaacggcacctaccaggtcgtctccgtcctccccatcgagcaccaggactggctcaccggcaaggagttcaagtgccgcgtcaaccacatcgacctcccctcccccatcgagcgcaccatctccaaggcccgcggccgcgcccacaagccctccgtctacgtcctccccccctcccccaaggagctctcctcctccgacaccgtctccatcacctgcctcatcaaggacttctacccccccgacatcgacgtcgagtggcagtccgtcggccagcaggagcccgagcgcaagcaccgcatgacccccccccagctcgacgaggacggctcctacttcctctactccaagctctccgtcgacaagtcccgctggcagcagggcgaccccttcacctgcgccgtcatgcacgagaccctccagaaccactacaccgacctctccctctcccactcccccggcaag

SEQ ID NO: 16335 - RNA, 1359 nt, synthetic construct
  misc_feature 1..1359: note = derived and/or modified sequence opt2 from Ranevetmab_HeavyChain2
  source 1..1359: mol_type = other RNA
gaggtccagctcgtcgagtccggcggcggcctcgtccagcccggcggctccctccgcctctcctgcgtcgcctccggcttctccctcaccaacaacaacgtcaactgggtccgccaggcccccggcaagggcctcgagtgggtcggcggcgtctgggccggcggcgccaccgactacaactccgccctcaagtcccgcttcaccatctcccgcgacaacgccaagaacaccgtcttcctccagatgcactccctccgctccgaggacaccgccgtctactactgcgcccgcgacggcggctactcctcctccaccctctacgccatggacgcctggggccagggcacctccgtcaccgtctcctccgcctccaccaccgccccctccgtcttccccctcgccccctcctgcggctccacctccggctccaccgtcgccctcgcctgcctcgtctccggctacttccccgagcccgtcaccgtctcctggaactccggctccctcacctccggcgtccacaccttcccctccgtcctccagtcctccggcctccactccctctcctccatggtcaccgtcccctcctcccgctggccctccgagaccttcacctgcaacgtcgtccaccccgcctccaacaccaaggtcgacaagcccgtcttcaacgagtgccgctgcaccgacacccccccctgccccgtccccgagcccctcggcggcccctccgtcctcatcttcccccccaagcccaaggacatcctccgcatcacccgcacccccgaggtcacctgcgtcgtcctcgacctcggccgcgaggaccccgaggtccagatctcctggttcgtcgacggcaaggaggtcctcaccgccaagacccagtcccgcgagcagcagttcaacggcacctaccaggtcgtctccgtcctccccatcgagcaccaggactggctcaccggcaaggagttcaagtgccgcgtcaaccacatcgacctcccctcccccatcgagcgcaccatctccaaggcccgcggccgcgcccacaagccctccgtctacgtcctccccccctcccccaaggagctctcctcctccgacaccgtctccatcacctgcctcatcaaggacttctacccccccgacatcgacgtcgagtggcagtccgtcggccagcaggagcccgagcgcaagcaccgcatgacccccccccagctcgacgaggacggctcctacttcctctactccaagctctccgtcgacaagtcccgctggcagcagggcgaccccttcacctgcgccgtcatgcacgagaccctccagaaccactacaccgacctctccctctcccactcccccggcaag

SEQ ID NO: 16336 - RNA, 651 nt, synthetic construct
  misc_feature 1..651: note = derived and/or modified sequence opt2 from Ranevetmab_LightChain
  source 1..651: mol_type = other RNA
gacatcgtcatgacccagtcccccgcctccctctccctctcccagggcgagaccgtcaccatcacctgccgcgcctccgaggacatctacaacgccctcgcctggtaccagcagaagcccggccaggcccccaagctcctcatctacaacaccgacaccctccacaccggcgtcccctcccgcttctccggctccggctccggcaccgacttctccctcaccatctcctccctcgagcccgaggacgtcgccgtctactactgccagcactacttccactacccccgcaccttcggccagggcaccaaggtcgagctcaagcgcaacgacgcccagcccgccgtctacctcttccagccctcccccgaccagctccacaccggctccgcctccgtcgtctgcctcctcaactccttctaccccaaggacatcaacgtcaagtggaaggtcgacggcgtcatccaggacaccggcatccaggagtccgtcaccgagcaggacaaggactccacctactccctctcctccaccctcaccatgtcctccaccgagtacctctcccacgagctctactcctgcgagatcacccacaagtccctcccctccaccctcatcaagtccttccagcgctccgagtgccagcgcgtcgac

SEQ ID NO: 16337 - RNA, 1761 nt, synthetic construct
  misc_feature 1..1761: note = derived and/or modified sequence opt2 from Remtolumab_HeavyChain
  source 1..1761: mol_type = other RNA
gaggtccagctcgtcgagtccggcggcggcctcgtccagcccggccgctccctccgcctctcctgcgccgcctccggcttcaccttcgacgactacgccatgcactgggtccgccaggcccccggcaagggcctcgagtgggtctccgccatcacctggaactccggccacatcgactacgccgactccgtcgagggccgcttcaccatctcccgcgacaacgccaagaactccctctacctccagatgaactccctccgcgccgaggacaccgccgtctactactgcgccaaggtctcctacctctccaccgcctcctccctcgactactggggccagggcaccctcgtcaccgtctcctccggcggcggcggctccggcggcggcggctccgaggtccagctcgtccagtccggcgccgaggtcaagaagcccggctcctccgtcaaggtctcctgcaaggcctccggcggctccttcggcggctacggcatcggctgggtccgccaggcccccggccagggcctcgagtggatgggcggcatcacccccttcttcggcttcgccgactacgcccagaagttccagggccgcgtcaccatcaccgccgacgagtccaccaccaccgcctacatggagctctccggcctcacctccgacgacaccgccgtctactactgcgcccgcgaccccaacgagttctggaacggctactactccacccacgacttcgactcctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16338 - RNA, 993 nt, synthetic construct
  misc_feature 1..993: note = derived and/or modified sequence opt2 from Remtolumab_LightChain
  source 1..993: mol_type = other RNA
gacatccagatgacccagtccccctcctccctctccgcctccgtcggcgaccgcgtcaccatcacctgccgcgcctcccagggcatccgcaactacctcgcctggtaccagcagaagcccggcaaggcccccaagctcctcatctacgccgcctccaccctccagtccggcgtcccctcccgcttctccggctccggctccggcaccgacttcaccctcaccatctcctccctccagcccgaggacgtcgccacctactactgccagcgctacaaccgcgccccctacaccttcggccagggcaccaaggtcgagatcaagcgcggcggctccggcggcggcggctccggcgagatcgtcctcacccagtcccccgacttccagtccgtcacccccaaggagaaggtcaccatcacctgccgcgcctcccaggacatcggctccgagctccactggtaccagcagaagcccgaccagccccccaagctcctcatcaagtacgcctcccactccacctccggcgtcccctcccgcttctccggctccggctccggcaccgacttcaccctcaccatcaacggcctcgaggccgaggacgccggcacctactactgccaccagaccgactccctcccctacaccttcggccccggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16339 - RNA, 1341 nt, synthetic construct
  misc_feature 1..1341: note = derived and/or modified sequence opt2 from Rosmantuzumab_HeavyChain
  source 1..1341: mol_type = other RNA
caggtccagctcgtccagtccggcgccgaggtcaagaagcccggcgcctccgtcaaggtctcctgcaaggcctccggctacaccttcaccgactactccatccactgggtccgccaggcccccggccagggcctcgagtggatcggctacatctacccctccaacggcgactccggctacaaccagaagttcaagaaccgcgtcaccatgacccgcgacacctccacctccaccgcctacatggagctctcccgcctccgctccgaggacaccgccgtctactactgcgccacctacttcgccaacaacttcgactactggggccagggcaccaccctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16340 - RNA, 654 nt, synthetic construct
  misc_feature 1..654: note = derived and/or modified sequence opt2 from Rosmantuzumab_LightChain
  source 1..654: mol_type = other RNA
gacatccagatgacccagtccccctcctccctctccgcctccgtcggcgaccgcgtcaccatcacctgcaaggcctcccagtccgtcgactacgacggcgactcctacatgaactggtaccagcagaagcccggcaaggcccccaagctcctcatctacgccgcctccaacctcgagtccggcgtcccctcccgcttctccggctccggctccggcaccgacttcaccctcaccatctcccccgtccaggccgaggacttcgccacctactactgccagcagtccaacgaggaccccctcaccttcggcgccggcaccaagctcgagctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16341 - RNA, 1332 nt, synthetic construct
  misc_feature 1..1332: note = derived and/or modified sequence opt2 from Rozanolixizumab_HeavyChain
  source 1..1332: mol_type = other RNA
gaggtccccctcgtcgagtccggcggcggcctcgtccagcccggcggctccctccgcctctcctgcgccgtctccggcttcaccttctccaactacggcatggtctgggtccgccaggcccccggcaagggcctcgagtgggtcgcctacatcgactccgacggcgacaacacctactaccgcgactccgtcaagggccgcttcaccatctcccgcgacaacgccaagtcctccctctacctccagatgaactccctccgcgccgaggacaccgccgtctactactgcaccaccggcatcgtccgccccttcctctactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtcgagtccaagtacggccccccctgccccccctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 16342 - RNA, 657 nt, synthetic construct
  misc_feature 1..657: note = derived and/or modified sequence opt2 from Rozanolixizumab_LightChain
  source 1..657: mol_type = other RNA
gacatccagatgacccagtccccctcctccctctccgcctccgtcggcgaccgcgtcaccatcacctgcaagtcctcccagtccctcgtcggcgcctccggcaagacctacctctactggctcttccagaagcccggcaaggcccccaagcgcctcatctacctcgtctccaccctcgactccggcatcccctcccgcttctccggctccggctccggcaccgagttcaccctcaccatctcctccctccagcccgaggacttcgccacctactactgcctccagggcacccacttcccccacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16343 - RNA, 1329 nt, synthetic construct
  misc_feature 1..1329: note = derived and/or modified sequence opt2 from Sapelizumab_HeavyChain
  source 1..1329: mol_type = other RNA
caggtccagctccaggagtccggccccggcctcgtcaagccctccgagaccctctccctcacctgcgccgtctccggccactccatctcccacgaccacgcctggtcctgggtccgccagccccccggcgagggcctcgagtggatcggcttcatctcctactccggcatcaccaactacaacccctccctccagggccgcgtcaccatctcccgcgacaactccaagaacaccctctacctccagatgaactccctccgcgccgaggacaccgccgtctactactgcgcccgctccctcgcccgcaccaccgccatggactactggggcgagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtcctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcaggagggcaacgtcttctcctgctccgtcatgcacgaggccctccacgcccactacacccagaagtccctctccctctccccc

SEQ ID NO: 16344 - RNA, 642 nt, synthetic construct
  misc_feature 1..642: note = derived and/or modified sequence opt2 from Sapelizumab_LightChain
  source 1..642: mol_type = other RNA
gacatccagatgacccagtccccctcctccctctccgcctccgtcggcgactccgtcaccatcacctgccaggcctccaccgacatctcctcccacctcaactggtaccagcagaagcccggcaaggcccccgagctcctcatctactacggctcccacctcctctccggcgtcccctcccgcttctccggctccggctccggcaccgacttcaccttcaccatctcctccctcgaggccgaggacgccgccacctactactgcggccagggcaaccgcctcccctacaccttcggccagggcaccaaggtcgagatcgagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16345 - RNA, 1356 nt, synthetic construct
  misc_feature 1..1356: note = derived and/or modified sequence opt2 from Selicrelumab_HeavyChain
  source 1..1356: mol_type = other RNA
caggtccagctcgtccagtccggcgccgaggtcaagaagcccggcgcctccgtcaaggtctcctgcaaggcctccggctacaccttcaccggctactacatgcactgggtccgccaggcccccggccagggcctcgagtggatgggctggatcaaccccgactccggcggcaccaactacgcccagaagttccagggccgcgtcaccatgacccgcgacacctccatctccaccgcctacatggagctcaaccgcctccgctccgacgacaccgccgtctactactgcgcccgcgaccagcccctcggctactgcaccaacggcgtctgctcctacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16346 - RNA, 642 nt, synthetic construct
  misc_feature 1..642: note = derived and/or modified sequence opt2 from Selicrelumab_LightChain
  source 1..642: mol_type = other RNA
gacatccagatgacccagtccccctcctccgtctccgcctccgtcggcgaccgcgtcaccatcacctgccgcgcctcccagggcatctactcctggctcgcctggtaccagcagaagcccggcaaggcccccaacctcctcatctacaccgcctccaccctccagtccggcgtcccctcccgcttctccggctccggctccggcaccgacttcaccctcaccatctcctccctccagcccgaggacttcgccacctactactgccagcaggccaacatcttccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16347 - RNA, 354 nt, synthetic construct
  misc_feature 1..354: note = derived and/or modified sequence opt2 from Solitomab_HeavyChain1
  source 1..354: mol_type = other RNA
gaggtccagctcctcgagcagtccggcgccgagctcgtccgccccggcacctccgtcaagatctcctgcaaggcctccggctacgccttcaccaactactggctcggctgggtcaagcagcgccccggccacggcctcgagtggatcggcgacatcttccccggctccggcaacatccactacaacgagaagttcaagggcaaggccaccctcaccgccgacaagtcctcctccaccgcctacatgcagctctcctccctcaccttcgaggactccgccgtctacttctgcgcccgcctccgcaactgggacgagcccatggactactggggccagggcaccaccgtcaccgtc

SEQ ID NO: 16348 - RNA, 375 nt, synthetic construct
  misc_feature 1..375: note = derived and/or modified sequence opt2 from Solitomab_HeavyChain2
  source 1..375: mol_type = other RNA
gacgtccagctcgtccagtccggcgccgaggtcaagaagcccggcgcctccgtcaaggtctcctgcaaggcctccggctacaccttcacccgctacaccatgcactgggtccgccaggcccccggccagggcctcgagtggatcggctacatcaacccctcccgcggctacaccaactacgccgactccgtcaagggccgcttcaccatcaccaccgacaagtccacctccaccgcctacatggagctctcctccctccgctccgaggacaccgccacctactactgcgcccgctactacgacgaccactactgcctcgactactggggccagggcaccaccgtcaccgtctcctccggcgagggcacctccacc

SEQ ID NO: 16349 - RNA, 1488 nt, synthetic construct
  misc_feature 1..1488: note = derived and/or modified sequence opt2 from Solitomab_LightChain_HeavyChain_HeavyChain_LightChain
  source 1..1488: mol_type = other RNA
gagctcgtcatgacccagtccccctcctccctcaccgtcaccgccggcgagaaggtcaccatgtcctgcaagtcctcccagtccctcctcaactccggcaaccagaagaactacctcacctggtaccagcagaagcccggccagccccccaagctcctcatctactgggcctccacccgcgagtccggcgtccccgaccgcttcaccggctccggctccggcaccgacttcaccctcaccatctcctccgtccaggccgaggacctcgccgtctactactgccagaacgactactcctaccccctcaccttcggcgccggcaccaagctcgagatcaagggcggcggcggctccggcggcggcggctccggcggcggcggctccgaggtccagctcctcgagcagtccggcgccgagctcgtccgccccggcacctccgtcaagatctcctgcaaggcctccggctacgccttcaccaactactggctcggctgggtcaagcagcgccccggccacggcctcgagtggatcggcgacatcttccccggctccggcaacatccactacaacgagaagttcaagggcaaggccaccctcaccgccgacaagtcctcctccaccgcctacatgcagctctcctccctcaccttcgaggactccgccgtctacttctgcgcccgcctccgcaactgggacgagcccatggactactggggccagggcaccaccgtcaccgtctcctccggcggcggcggctccgacgtccagctcgtccagtccggcgccgaggtcaagaagcccggcgcctccgtcaaggtctcctgcaaggcctccggctacaccttcacccgctacaccatgcactgggtccgccaggcccccggccagggcctcgagtggatcggctacatcaacccctcccgcggctacaccaactacgccgactccgtcaagggccgcttcaccatcaccaccgacaagtccacctccaccgcctacatggagctctcctccctccgctccgaggacaccgccacctactactgcgcccgctactacgacgaccactactgcctcgactactggggccagggcaccaccgtcaccgtctcctccggcgagggcacctccaccggctccggcggctccggcggctccggcggcgccgacgacatcgtcctcacccagtcccccgccaccctctccctctcccccggcgagcgcgccaccctctcctgccgcgcctcccagtccgtctcctacatgaactggtaccagcagaagcccggcaaggcccccaagcgctggatctacgacacctccaaggtcgcctccggcgtccccgcccgcttctccggctccggctccggcaccgactactccctcaccatcaactccctcgaggccgaggacgccgccacctactactgccagcagtggtcctccaaccccctcaccttcggcggcggcaccaaggtcgagatcaag

SEQ ID NO: 16350 - RNA, 339 nt, synthetic construct
  misc_feature 1..339: note = derived and/or modified sequence opt2 from Solitomab_LightChain1
  source 1..339: mol_type = other RNA
gagctcgtcatgacccagtccccctcctccctcaccgtcaccgccggcgagaaggtcaccatgtcctgcaagtcctcccagtccctcctcaactccggcaaccagaagaactacctcacctggtaccagcagaagcccggccagccccccaagctcctcatctactgggcctccacccgcgagtccggcgtccccgaccgcttcaccggctccggctccggcaccgacttcaccctcaccatctcctccgtccaggccgaggacctcgccgtctactactgccagaacgactactcctaccccctcaccttcggcgccggcaccaagctcgagatcaag

SEQ ID NO: 16351 - RNA, 324 nt, synthetic construct
  misc_feature 1..324: note = derived and/or modified sequence opt2 from Solitomab_LightChain2
  source 1..324: mol_type = other RNA
gccgacgacatcgtcctcacccagtcccccgccaccctctccctctcccccggcgagcgcgccaccctctcctgccgcgcctcccagtccgtctcctacatgaactggtaccagcagaagcccggcaaggcccccaagcgctggatctacgacacctccaaggtcgcctccggcgtccccgcccgcttctccggctccggctccggcaccgactactccctcaccatcaactccctcgaggccgaggacgccgccacctactactgccagcagtggtcctccaaccccctcaccttcggcggcggcaccaaggtcgagatcaag

SEQ ID NO: 16352 - RNA, 1359 nt, synthetic construct
  misc_feature 1..1359: note = derived and/or modified sequence opt2 from Suptavumab_HeavyChain2
  source 1..1359: mol_type = other RNA
gaggtccagctcgtcgagtccggcggcgacctcgtccagcccggccgctccctccgcctctcctgcgtcgcctccggcttcaccttcgacgactacgccatgcactgggtccgccaggcccccggcaagggcctcgagtgggtctccggcgtctcctggtccggctccaccgtcggctacgccgactccgtcaagggccgcttcaccgtctcccgcgacaacgcccagaagtccctctacctccagatgaactccctccgcgccgaggacaccgccctctactactgcgtcaaggacgcctacaagttcaactactactactacggcctcgacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16353 - RNA, 1356 nt, synthetic construct
  misc_feature 1..1356: note = derived and/or modified sequence opt2 from Suvratoxumab_HeavyChain
  source 1..1356: mol_type = other RNA
gaggtccagctcgtcgagtccggcggcggcctcgtccagcccggcggctccctccgcctctcctgcgccgcctccggcttcaccttctcctcccacgacatgcactgggtccgccaggccaccggcaagggcctcgagtgggtctccggcatcggcaccgccggcgacacctactaccccgactccgtcaagggccgcttcaccatctcccgcgagaacgccaagaactccctctacctccagatgaactccctccgcgccggcgacaccgccgtctactactgcgcccgcgaccgctactcccccaccggccactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctctacatcacccgcgagcccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16354 - RNA, 639 nt, synthetic construct
  misc_feature 1..639: note = derived and/or modified sequence opt2 from Suvratoxumab_LightChain
  source 1..639: mol_type = other RNA
gacatccagatgacccagtccccctccaccctctccgcctccgtcggcgaccgcgtcaccatcacctgccgcgcctcccagtccatctcctcctggctcgcctggtaccagcagaagcccggcaaggcccccaagctcctcatctacaaggcctcctccctcgagtccggcgtcccctcccgcttctccggctccggctccggcaccgagttcaccctcaccatctcctccctccagcccgacgacttcgccacctactactgcaagcagtacgccgactactggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16355 - RNA, 642 nt, synthetic construct
  misc_feature 1..642: note = derived and/or modified sequence opt2 from Tadocizumab_LightChain
  source 1..642: mol_type = other RNA
gacatccagatgacccagaccccctccaccctctccgcctccgtcggcgaccgcgtcaccatctcctgccgcgcctcccaggacatcaacaactacctcaactggtaccagcagaagcccggcaaggcccccaagctcctcatctactacacctccaccctccactccggcgtcccctcccgcttctccggctccggctccggcaccgactacaccctcaccatctcctccctccagcccgacgacttcgccacctacttctgccagcagggcaacaccctcccctggaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16356 - RNA, 1341 nt, synthetic construct
  misc_feature 1..1341: note = derived and/or modified sequence opt2 from Tanezumab_HeavyChain
  source 1..1341: mol_type = other RNA
caggtccagctccaggagtccggccccggcctcgtcaagccctccgagaccctctccctcacctgcaccgtctccggcttctccctcatcggctacgacctcaactggatccgccagccccccggcaagggcctcgagtggatcggcatcatctggggcgacggcaccaccgactacaactccgccgtcaagtcccgcgtcaccatctccaaggacacctccaagaaccagttctccctcaagctctcctccgtcaccgccgccgacaccgccgtctactactgcgcccgcggcggctactggtacgccacctcctactacttcgactactggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16357 - RNA, 642 nt, synthetic construct
  misc_feature 1..642: note = derived and/or modified sequence opt2 from Tanezumab_LightChain
  source 1..642: mol_type = other RNA
gacatccagatgacccagtccccctcctccctctccgcctccgtcggcgaccgcgtcaccatcacctgccgcgcctcccagtccatctccaacaacctcaactggtaccagcagaagcccggcaaggcccccaagctcctcatctactacacctcccgcttccactccggcgtcccctcccgcttctccggctccggctccggcaccgacttcaccttcaccatctcctccctccagcccgaggacatcgccacctactactgccagcaggagcacaccctcccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16358 - RNA, 1353 nt, synthetic construct
  misc_feature 1..1353: note = derived and/or modified sequence opt2 from Tavolixizumab_HeavyChain
  source 1..1353: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagtactccctccagctcaactccgtcacccccgaggacaccgccgtctactactgcgcccgctacaagtacgactacgacggcggccacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccaggaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16359 - RNA, 642 nt, synthetic construct
  misc_feature 1..642: note = derived and/or modified sequence opt2 from Tavolixizumab_LightChain
  source 1..642: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctccaagctccactccggcgtcccctcccgcttctccggctccggctccggcaccgactacaccctcaccatctcctccctccagcccgaggacttcgccacctactactgccagcagggctccgccctcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16360 - RNA, 1335 nt, synthetic construct
  misc_feature 1..1335: note = derived and/or modified sequence opt2 from Telisotuzumab_HeavyChain
  source 1..1335: mol_type = other RNA
caggtccagctcgtccagtccggcgccgaggtcaagaagcccggcgcctccgtcaaggtctcctgcaaggcctccggctacatcttcaccgcctacaccatgcactgggtccgccaggcccccggccagggcctcgagtggatgggctggatcaagcccaacaacggcctcgccaactacgcccagaagttccagggccgcgtcaccatgacccgcgacacctccatctccaccgcctacatggagctctcccgcctccgctccgacgacaccgccgtctactactgcgcccgctccgagatcaccaccgagttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgactgccactgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 16361 - RNA, 654 nt, synthetic construct
  misc_feature 1..654: note = derived and/or modified sequence opt2 from Telisotuzumab_LightChain
  source 1..654: mol_type = other RNA
gacatcgtcatgacccagtcccccgactccctcgccgtctccctcggcgagcgcgccaccatcaactgcaagtcctccgagtccgtcgactcctacgccaactccttcctccactggtaccagcagaagcccggccagccccccaagctcctcatctaccgcgcctccacccgcgagtccggcgtccccgaccgcttctccggctccggctccggcaccgacttcaccctcaccatctcctccctccaggccgaggacgtcgccgtctactactgccagcagtccaaggaggaccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16362 - RNA, 1335 nt, synthetic construct; identical to SEQ ID NO: 16360
  misc_feature 1..1335: note = derived and/or modified sequence opt2 from Telisotuzumab_vedotin_HeavyChain
  source 1..1335: mol_type = other RNA

SEQ ID NO: 16363 - RNA, 654 nt, synthetic construct; identical to SEQ ID NO: 16361
  misc_feature 1..654: note = derived and/or modified sequence opt2 from Telisotuzumab_vedotin_LightChain
  source 1..654: mol_type = other RNA

SEQ ID NO: 16364 - RNA, 1350 nt, synthetic construct
  misc_feature 1..1350: note = derived and/or modified sequence opt2 from Timigutuzumab_HeavyChain
  source 1..1350: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 16365 - RNA, 642 nt, synthetic construct; identical to SEQ ID NO: 16026
  misc_feature 1..642: note = derived and/or modified sequence opt2 from Timigutuzumab_LightChain
  source 1..642: mol_type = other RNA

SEQ ID NO: 16366 - RNA, 1332 nt, synthetic construct; identical to SEQ ID NO: 15410
  misc_feature 1..1332: note = derived and/or modified sequence opt2 from Timolumab_HeavyChain
  source 1..1332: mol_type = other RNA

SEQ ID NO: 16367 - RNA, 642 nt, synthetic construct; identical to SEQ ID NO: 15411
  misc_feature 1..642: note = derived and/or modified sequence opt2 from Timolumab_LightChain
  source 1..642: mol_type = other RNA

SEQ ID NO: 16368 - RNA, 1347 nt, synthetic construct
  misc_feature 1..1347: note = derived and/or modified sequence opt2 from Tomuzotuximab_HeavyChain
  source 1..1347: mol_type = other RNA
caggtccagctcaagcagtccggccccggcctcgtccagccctcccagtccctctccatcacctgcaccgtctccggcttctccctcaccaactacggcgtccactgggtccgccagtcccccggcaagggcctcgagtggctcggcgtcatctggtccggcggcaacaccgactacaacacccccttcacctcccgcctctccatcaacaaggacaactccaagtcccaggtcttcttcaagatgaactccctccagtccaacgacaccgccatctactactgcgcccgcgccctcacctactacgactacgagttcgcctactggggccagggcaccctcgtcaccgtctccaccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 16369 - RNA, 642 nt, synthetic construct; identical to SEQ ID NO: 15441
  misc_feature 1..642: note = derived and/or modified sequence opt2 from Tomuzotuximab_LightChain
  source 1..642: mol_type = other RNA

SEQ ID NO: 16370 - RNA, 1347 nt, synthetic construct; identical to SEQ ID NO: 16169
  misc_feature 1..1347: note = derived and/or modified sequence opt2 from Trastuzumab_duocarmazine_HeavyChain
  source 1..1347: mol_type = other RNA

SEQ ID NO: 16371 - RNA, 642 nt, synthetic construct; identical to SEQ ID NO: 16026
  misc_feature 1..642: note = derived and/or modified sequence opt2 from Trastuzumab_duocarmazine_LightChain
  source 1..642: mol_type = other RNA

SEQ ID NO: 16372 - RNA, 1368 nt, synthetic construct
  misc_feature 1..1368: note = derived and/or modified sequence opt2 from Varisacumab_HeavyChain
  source 1..1368: mol_type = other RNA
caggtccagctcgtccagtccggcgccgaggtcaagaagcccggcgcctccgtcaaggtctcctgcaaggcctccggcggcaccttctcctcctacgccatctcctgggtccgccaggcccccggccagggcctcgagtggatgggcggcttcgaccccgaggacggcgagaccatctacgcccagaagttccagggccgcgtcaccatgaccgaggacacctccaccgacaccgcctacatggagctctcctccctccgctccgaggacaccgccgtctactactgcgccaccggccgctccatggtccgcggcgtcatcatccccttcaacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16373 - RNA, 642 nt, synthetic construct
  misc_feature 1..642: note = derived and/or modified sequence opt2 from Varisacumab_LightChain
  source 1..642: mol_type = other RNA
gacatccgcatgacccagtccccctcctccctctccgcctccgtcggcgaccgcgtcaccatcacctgccgcgcctcccagtccatctcctcctacctcaactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagtcctactccacccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16374 - RNA, 1359 nt, synthetic construct
  misc_feature 1..1359: note = derived and/or modified sequence opt2 from Vunakizumab_HeavyChain
  source 1..1359: mol_type = other RNA
gaggtccagctcgtccagtccggcgccgaggtcaagaagcccggcgcctccgtcaaggtctcctgcaaggcctccggctacaccttcaccgactacgaggtccactgggtccgccaggcccccggccagggcctcgagtggatgggcgtcatcgaccccggcaccggcggcgtcgcctacaaccagaagttcgagggccgcgtcaccatgaccgccgacacctccacctccaccgcctacatggagctccgctccctccgctccgacgacaccgccgtctactactgcacccgctactccctcttctacggctcctccccctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16375 - RNA, 639 nt, synthetic construct
  misc_feature 1..639: note = derived and/or modified sequence opt2 from Vunakizumab_LightChain
  source 1..639: mol_type = other RNA
gagatcgtcctcacccagtcccccgacttccagtccgtcacccccaaggagaaggtcaccatcacctgctccgcctcctcctccgtcaactacatgcactggttccagcagaagcccgaccagtcccccaagctctggatctaccgcacctccaacctcgcctccggcgtcccctcccgcttctccggctccggctccggcaccgactacaccctcaccatcaactccctcgaggccgaggacgccgccacctactactgccagcagcgctcctcctacccctggaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16376 - RNA, 1341 nt, synthetic construct; identical to SEQ ID NO: 16279
  misc_feature 1..1341: note = derived and/or modified sequence opt2 from Xentuzumab_HeavyChain
  source 1..1341: mol_type = other RNA

SEQ ID NO: 16377 - RNA, 648 nt, synthetic construct; identical to SEQ ID NO: 16280
  misc_feature 1..648: note = derived and/or modified sequence opt2 from Xentuzumab_LightChain
  source 1..648: mol_type = other RNA

SEQ ID NO: 16378 - RNA, 726 nt, synthetic construct
  misc_feature 1..726: note = derived and/or modified sequence opt2 from anti-rabies_SO57_LightChain
  source 1..726: mol_type = other RNA
atgtccgtccccaccatggcctgggccctcctcctcctctccctcctcacccagggcaccggctcctgggcccagtccgccctcacccagccccgctccgtctccggctcccccggccagtccgtcaccatctcctgcaccggcacctcctccgacatcggcggctacaacttcgtctcctggtaccagcagcaccccggcaaggcccccaagctcatgatctacgacgccaccaagcgcccctccggcgtccccgaccgcttctccggctccaagtccggcaacaccgcctccctcaccatctccggcctccaggccgaggacgaggccgactactactgctgctcctacgccggcgactacacccccggcgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16379 - RNA, 1428 nt, synthetic construct
  misc_feature 1..1428: note = derived and/or modified sequence opt2 from anti-rabies_SO57_HeavyChain
  source 1..1428: mol_type = other RNA
atggactggacctggcgcttcctcttcgtcgtcgccgccgccaccggcgtccagtcccaggtccagctcgtccagtccggcgccgaggtcaagaagcccggctcctccgtcaaggtctcctgcaaggcctccggcggcaccttcaaccgctacaccgtcaactgggtccgccaggcccccggccagggcctcgagtggatgggcggcatcatccccatcttcggcaccgccaactacgcccagcgcttccagggccgcctcaccatcaccgccgacgagtccacctccaccgcctacatggagctctcctccctccgctccgacgacaccgccgtctacttctgcgcccgcgagaacctcgacaactccggcacctactactacttctccggctggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16380 - RNA, 696 nt, synthetic construct
  misc_feature 1..696: note = derived and/or modified sequence opt2 from anti-rabies_SOJB_LightChain
  source 1..696: mol_type = other RNA
atggcctggaccgtcctcctcctcggcctcctctcccactgcaccggctccgtcacctcctacgtcctcacccagcccccctccgtctccgtcgcccccggcaagaccgcccgcatcaactgcggcggcaacaacatcgagtaccgctccgtccactggtaccagcagaagtccggccaggcccccgtcgccgtcatctacgacaactccgaccgcccctccggcatccccgagcgcttctccggctccaagtccggcaacaccgccaccctcaccatctcccgcgtcgaggccggcgacgaggccgactactactgccaggtctgggacatctcctccgacgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16381 - RNA, 1554 nt, synthetic construct
  misc_feature 1..1554: note = derived and/or modified sequence opt2 from anti-rabies_SOJB_HeavyChain
  source 1..1554: mol_type = other RNA
atggacaccctctgctccaccctcctcctcctcaccatcccctcctgggtcctctcccagatcaccctcaaggagaccggccccaccctcgtcaagcccacccagaccctcaccctcacctgcaccttctccggcttctccctctccacctccggcgtcggcgtcggctggatccgccagccccccggcaaggccctcgagtgggtcaccctcatctactgggacgacgacaagcgctactccccctccctcgagaaccgcgtcaccatccgcaaggacacctccaagaaccaggtcgccctcaccatgaccaacatggaccccctcgacaccggcacctactactgcgcccaccgccagcacatctcctccttcccctggttcgactcctggggccagggcaccctcgtcaccgtctcctccgcctccaccaagggcccctccgtcttccccctcgccccctgctcccgctccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacacctgcaacgtcaaccacaagccctccaacaccaaggtcgacaagcgcgtcgagctcaagacccccctcggcgacaccacccacacctgcccccgctgccccgagcccaagtcctgcgacaccccccccccctgcccccgctgccccgagcccaagtcctgcgacaccccccccccctgcccccgctgccccgagcccaagtcctgcgacaccccccccccctgcccccgctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtccagttcaagtggtacgtcgacggcgtcgaggtccacaacgccaagaccaagccccgcgaggagcagttcaactccaccttccgcgtcgtctccgtcctcaccgtcctccaccaggactggctcaacggcaaggagtacaagtgcaaggtctccaacaaggccctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtcctccggccagcccgagaacaactacaacaccaccccccccatgctcgactccgacggctccttcttcctctactccaagctcaccgtcgacaagtcccgctggcagcagggcaacatcttctcctgctccgtcatgcacgaggccctccacaaccgcttcacccagaagtccctctccctctcccccggcaag

SEQ ID NO: 16382 - RNA, 702 nt, synthetic construct
  misc_feature 1..702: note = derived and/or modified sequence opt2 from anti-rabies_SOJA_LightChain
  source 1..702: mol_type = other RNA
atggaggcccccgcccagctcctcttcctcctcctcctctggctccccgacaccaccggcgagatcgtcctcacccagtcccccgccaccctctccctctcccccggcgagcgcgccaccctcgcctgccgcgcctcccagaccgcctcccgctacctcgcctggtaccagcagaagcccggccaggccccccgcctcctcatctacgacacctccaaccgcgccaccggcatccccgcccgcttctccggctccggctccggcaccgacttcaccctctccatctcctccctcgagcccgaggacttcgccgtctactactgccagcagcgcttcaactggccctggaccttcggccagggcaccaaggtcgagttcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16383 - RNA, 1422 nt, synthetic construct
  misc_feature 1..1422: note = derived and/or modified sequence opt2 from anti-rabies_SOJA_HeavyChain
  source 1..1422: mol_type = other RNA
atggagttcggcctctcctggctcttcctcgtcgccatcctcaagggcgtccagtgcgaggtccagctcctcgagtccggcggcggcctcgtccagcccggcggctccctccgcctctcctgcgccgcctccggcttcaccttctccaactacgccatgtcctgggtccgccaggcccccggcaagggcctcgagtgggtctccgccatctccgcctccggccactccacctacctcgccgactccgtcaagggccgcttcaccatctcccgcgacaactccaagaacaccctctacctccagatgaactccctccgcgccgaggacaccgccgtctactactgcgccaaggaccgcgaggtcaccatgatcgtcgtcctcaacggcggcttcgactactggggccagggcacccgcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 16384 - RNA, 321 nt, synthetic construct
  misc_feature 1..321: note = derived and/or modified sequence opt2 from anti-rabies_LightChain
  source 1..321: mol_type = other RNA
gtcatgacccagtcccccgccaccctctccctctcccccggcgagcgcgccaccctctcctgccgcgcctcccagtccgtccgcaactacctcgcctggtaccagcagaagcccggccaggccccccgcctcctcatctacggcgcctccaaccgcgccaccggcatccccgcccgcttctccggctccggctccggcaccgacttcaccctcaccatctcctccctcgagcccgaggacttcgccgtctactactgccagcagcgctccgactggcccctctccttcggccagggcaccaagctcgagatcaagcgcacc

SEQ ID NO: 16385 - RNA, 333 nt, synthetic construct
  misc_feature 1..333: note = derived and/or modified sequence opt2 from anti-rabies_HeavyChain
  source 1..333: mol_type = other RNA
ggccccgcctgggaggtccccgagaccctccccgtccagcccctcgactccccctccgtcgccatggcctgcaccggcgtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggactccaactccggctcctactacgcccacgacctcggctactggggccagggcaccctcgtcaccgtc

SEQ ID NO: 16386 - RNA, 342 nt, synthetic construct
  misc_feature 1..342: note = derived and/or modified sequence opt2 from anti-rabies_LightChain
  source 1..342: mol_type = other RNA
gagctcgtcatgacccagtcccccctctccctccccgtcaccctcggccagcccgcctccatctcctgccgctcctcccagtccctcatccactccaacggcaacacctacctcaactggttccagcagcgccccggccagtccccccgccgcctcatctacaaggtctccgaccgcgactccggcgtccccgaccgcttctccggctccggctccggcaccgacttcaccctcaagatctcccgcgtcgaggccgaggacgtcggcgtctactactgcctccagggcacccactggccccgcaccttcggccagggcaccaagctcgagatcaagcgcacc

SEQ ID NO: 16387 - RNA, 351 nt, synthetic construct
  misc_feature 1..351: note = derived and/or modified sequence opt2 from anti-rabies_HeavyChain
  source 1..351: mol_type = other RNA
gtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgcccgcgacaaggccctcgccgcccgccgcggctactactactactacggcaccgacgtctggggccagggcaccctcgtcaccgtctcctcc

SEQ ID NO: 16388 - RNA, 648 nt, synthetic construct
  misc_feature 1..648: note = derived and/or modified sequence opt2 from anti-RSV_5ITB_LightChain
  source 1..648: mol_type = other RNA
tccgacatccagatgacccagtccccctccaccctctccgcctccgtcggcgaccgcgtcaccatcacctgccgcgcctcccagtccatctcctcctggctcgcctggtaccagcagaagcccggcaaggcccccaagctcctcatctacgacgcctcctccctcgagtccggcgtcccctcccgcttctccggctccggctccggcaccgagttcaccctcaccatctcctccctccagcccgacgacttcgccacctactactgccagcagtacaacacctactcctggtggaccttcggccagggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16389 - RNA, 660 nt, synthetic construct
  misc_feature 1..660: note = derived and/or modified sequence opt2 from anti-RSV_5ITB_HeavyChain
  source 1..660: mol_type = other RNA
gtcgagtccggcggcggcctcatccagcccggcggctccctccgcctctcctgcgccgtctccggcttcaccgtctcctccaagtacatgacctgggtccgccaggcccccggcaagggcctcgagtgggtctccgtcatctacggcggcggctccacctactacgccgactccgtcgtcggccgcttcaccatctcccgcgacaactccaagaacaccctctacctccagatgaactccctccgcgccgaggacaccgccgtctactactgcgcctcccgcctcggcgtccgcgccaccaccggcgacctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgc

SEQ ID NO: 16390 - RNA, 639 nt, synthetic construct; identical to SEQ ID NO: 16354
  misc_feature 1..639: note = derived and/or modified sequence opt2 from anti-alpha-toxin_4U6V_LightChain
  source 1..639: mol_type = other RNA

SEQ ID NO: 16391 - RNA, 675 nt, synthetic construct
  misc_feature 1..675: note = derived and/or modified sequence opt2 from anti-alpha-toxin_4U6V_HeavyChain
  source 1..675: mol_type = other RNA
gaggtccagctcgtcgagtccggcggcggcctcgtccagcccggcggctccctccgcctctcctgcgccgcctccggcttcaccttctcctcccacgacatgcactgggtccgccaggccaccggcaagggcctcgagtgggtctccggcatcggcaccgccggcgacacctactaccccgactccgtcaagggccgcttcaccatctcccgcgagaacgccaagaactccctctacctccagatgaactccctccgcgccggcgacaccgccgtctactactgcgcccgcgaccgctactcccccaccggccactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgc

SEQ ID NO: 16392 - RNA, 879 nt, synthetic construct
  misc_feature 1..879: note = derived and/or modified sequence opt2 from anti-alpha-toxin_4U6V_Chain-A
  source 1..879: mol_type = other RNA
gccgactccgacatcaacatcaagaccggcaccaccgacatcggctccaacaccaccgtcaagaccggcgacctcgtcacctacgacaaggagaacggcatgcacaagaaggtcttctactccttcatcgacgacaagaaccacaacaagaagctcctcgtcatccgcaccaagggcaccatcgccggccagtaccgcgtctactccgaggagggcgccaacaagtccggcctcgcctggccctccgccttcaaggtccagctccagctccccgacaacgaggtcgcccagatctccgactactacccccgcaactccatcgacaccaaggagtacatgtccaccctcacctacggcttcaacggcaacgtcaccggcgacgacaccggcaagatcggcggcctcatcggcgccaacgtctccatcggccacaccctcaagtacgtccagcccgacttcaagaccatcctcgagtcccccaccgacaagaaggtcggctggaaggtcatcttcaacaacatggtcaaccagaactggggcccctacgaccgcgactcctggaaccccgtctacggcaaccagctcttcatgaagacccgcaacggctccatgaaggccgccgacaacttcctcgaccccaacaaggcctcctccctcctctcctccggcttctcccccgacttcgccaccgtcatcaccatggaccgcaaggcctccaagcagcagaccaacatcgacgtcatctacgagcgcgtccgcgacgactaccagctccactggacctccaccaactggaagggcaccaacaccaaggacaagtggatcgaccgctcctccgagcgctacaagatcgactgggagaaggaggagatgaccaac

SEQ ID NO: 16393 - RNA, 879 nt, synthetic construct; identical to SEQ ID NO: 16392
  misc_feature 1..879: note = derived and/or modified sequence opt2 from anti-alpha-toxin_4U6V_Chain-B
  source 1..879: mol_type = other RNA

SEQ ID NO: 16394 - RNA, 642 nt, synthetic construct
  misc_feature 1..642: note = derived and/or modified sequence opt2 from anti-IsdB_5D1Q_Chain-A
  source 1..642: mol_type = other RNA
gacatccagctcacccagtccccctcctccgtctccgcctccgtcggcgaccgcatcaccatcacctgccgcgcctcccaggacatctccaactgggtcgcctggtaccagcagaagcccggcaaggcccccaagctcctcatctactccgcctcctccctccagtccggcgtcccctcccgcttctccggctccggctccggcaccgacttcaccctcaccatctcctccctccagcccgaggacttcgccacctactactgccagcaggccaacaccttcccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16395 - RNA, 783 nt, synthetic construct
  misc_feature 1..783: note = derived and/or modified sequence opt2 from anti-IsdB_5D1Q_Chain-B
  source 1..783: mol_type = other RNA
caggtccagctcgtccagtccggcgccgaggtcaagaagcccgcctcctccgtcaaggtctcctgccaggcctccggcggctccttctccacccgcaccatctcctggctccgccaggcccccggccagggcctcgagtggatgggcggcatctcccccatcttcggcgccgccaactacgcccagcgcttccagggccgcgtcaccatcaccgccgacaagtccacctccaccgcctacatggagctcacctccctcacctccgaggacaccgccgtctactactgcgcccgcgaccgcccccccggcgcccagttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcggcggcggctccggccaccaccaccaccaccaccaccaccaccacggcggcgactacaaggaccacgacggcgactacaaggaccacgacatcgactacaaggacgacgacgacaag

SEQ ID NO: 16396 - RNA, 822 nt, synthetic construct
  misc_feature 1..822: note = derived and/or modified sequence opt2 from anti-IsdB_5D1Q_Chain-C
  source 1..822: mol_type = other RNA
gaggtccagctcgtcgagtccggcggcggcctcgtccagcccggcggctccctcaccctctcctgcgccgcctccggcctcatcttctccgactccaccatgcactgggtccgccaggcctccggccgcggcctcgagtgggtcgcccgcatccgctccaaggccaacaactacgccacctcctccgacaagtccgccaccgcctacctcgcctccgtcaagggccgcttcaccatctcccgcgacgactccaaggacaccaccttcctcgagatgtcctccctcaagatcgaggacaccgccgtctactactgcatcgcctcctccaccaccggctggtacgtccgcgaggacttcgactactggggccacggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcggcggcggctccggccaccaccaccaccaccaccaccaccaccacggcggcgactacaaggaccacgacggcgactacaaggaccacgacatcgactacaaggacgacgacgacaag

SEQ ID NO: 16397 - RNA, 648 nt, synthetic construct
  misc_feature 1..648: note = derived and/or modified sequence opt2 from anti-IsdB_5D1Q_Chain-D
  source 1..648: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctctccatctcccgcctcgagcccgaggacttcgccgtctactactgcctccactacggcacctcccccatgtacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16398 - RNA, 360 nt, synthetic construct
  misc_feature 1..360: note = derived and/or modified sequence opt2 from anti-IsdB_5D1Q_Chain-E
  source 1..360: mol_type = other RNA
cccggcaagatgaccgacctccaggacaccaagtacgtcgtctacgagtccgtcgagaacaacgagtccatgatggacaccttcgtcaagcaccccatcaagaccggcatgctcaacggcaagaagtacatggtcatggagaccaccaacgacgactactggaaggacttcatggtcgagggccagcgcgtccgcaccatctccaaggacgccaagaacaacacccgcaccatcatcttcccctacgtcgagggcaagaccctctacgacgccatcgtcaaggtccacgtcaagaccatcgactacgacggccagtaccacgtccgcatcgtcgacaaggaggccttcaccaaggccaac

SEQ ID NO: 16399 - RNA, 657 nt, synthetic construct
  misc_feature 1..657: note = derived and/or modified sequence opt2 from anti-IsdB_5D1X_Chain-A
  source 1..657: mol_type = other RNA
gacatcgtcatgacccagtcccccctctccctccccgtcaccctcggccagcccgcctccatctcctgctcctccgcccagtccctcgtccactccgacggcgactcctacctcacctggttccaccagcgccccggccagtccccccgccgcctcatctacaaggtctccatccgcgacgccggcgtccccgaccgcttctccggctccggctccggcaccgacttcaccctcaagatctcccgcgtcgaggccgaggacgtcggcgtctactactgcatgcaggccacccactggccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16400 - RNA, 777 nt, synthetic construct
  misc_feature 1..777: note = derived and/or modified sequence opt2 from anti-IsdB_5D1X_Chain-B
  source 1..777: mol_type = other RNA
caggtccagctcgtccagtccggctccgaggtcaagaagcccggctcctccgtcaccctctcctgcaaggcctccggcgacaccttcaacacccacacctactcctgggtccgccaggcccccggccagcgcctcgagtggatcggcggcatcatgcccatcttcgccgcctccaagtccgccccccacctccaggaccgcctcaccatcaccgccaacaaggccacccgcaccgcctacatggagctcacctccctcacctccgacgactccggcgtctactactgcgcccgcgacggccgcggcgccctccagtactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcggcggcggctccggccaccaccaccaccaccaccaccaccaccacggcggcgactacaaggaccacgacggcgactacaaggaccacgacatcgactacaaggacgacgacgacaag

SEQ ID NO: 16401 - RNA, 822 nt, synthetic construct; identical to SEQ ID NO: 16396
  misc_feature 1..822: note = derived and/or modified sequence opt2 from anti-IsdB_5D1X_Chain-C
  source 1..822: mol_type = other RNA

SEQ ID NO: 16402 - RNA, 648 nt, synthetic construct
  misc_feature 1..648: note = derived and/or modified sequence opt2 from anti-IsdB_5D1X_Chain-D
  source 1..648: mol_type = other RNA
gagatcgtcctcacccagacccccgccaccctctccctcacccccggcgagcgcgccaccctcacctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctctccatctcccgcctcgagcccgaggacttcgccgtctactactgcctccactacggcacctcccccatgtacttcttcggccgcggcaccgtcctcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16403 - RNA, 354 nt, synthetic construct
  misc_feature 1..354: note = derived and/or modified sequence opt2 from anti-IsdB_5D1X_Chain-E
  source 1..354: mol_type = other RNA
aagatgaccgacctccaggacaccaagtacgtcgtctacgagtccgtcgagaacaacgagtccatgatggacaccttcgtcaagcaccccatcaagaccggcatgctcaacggcaagaagtacatggtcatggagaccaccaacgacgactactggaaggacttcatggtcgagggccagcgcgtccgcaccatctccaaggacgccaagaacaacacccgcaccatcatcttcccctacgtcgagggcaagaccctctacgacgccatcgtcaaggtccacgtcaagaccatcgactacgacggccagtaccacgtccgcatcgtcgacaaggaggccttcaccaaggccaac

SEQ ID NO: 16404 - RNA, 792 nt, synthetic construct
  misc_feature 1..792: note = derived and/or modified sequence opt2 from anti-IsdB_5D1Z_Chain-B
  source 1..792: mol_type = other RNA
gccgaggtccagctcgtcgagtccggcggcggcgtcgtccagcccggcggctccctccgcctctcctgcgccgcctccggcttcaccttcaacaagttctggatgaactgggtccgccaggcccccggcaagggcctcgagtgggtcgccgacatccaggtcgacggctccgagaagaactacgtcgactccgtcaagggccgcttcaccatctcccgcgacaacggcaagaactccctctacctccagatgaactccctccgcgccgaggacaccggcgtctactactgcgcccgcggccgctacgactactggtccggctacctctccccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcggcggcggctccggccaccaccaccaccaccaccaccaccaccacggcggcgactacaaggaccacgacggcgactacaaggaccacgacatcgactacaaggacgacgacgacaag

SEQ ID NO: 16405 - RNA, 642 nt, synthetic construct
  misc_feature 1..642: note = derived and/or modified sequence opt2 from anti-IsdB_5D1Z_Chain-C
  source 1..642: mol_type = other RNA
gacatccagctcacccagtccccctccttcctctccgcctccgtcgccgaccgcgtcaccatcacctgccgcgcctcccaggccgtccgctcctccctcgcctggtaccagcagaagcccggcaaggccccccagctcctcatctactccgcctccaccctcgagaacggcgtctcctcccgcttctccggctccggccccggcaccgagttcaccctcaccatctcctccctccagcccgaggacgtcggcacctactactgccagcagctcaacacctaccccttcaccttcggccccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16406 - RNA, 810 nt, synthetic construct
  misc_feature 1..810: note = derived and/or modified sequence opt2 from anti-IsdB_5D1Z_Chain-D
  source 1..810: mol_type = other RNA
caggtccagctccaggagtccggccccggcctcgtcaagccctccgagaccctctccctcatctgcaccgtctccggcggctccatctcctcctcctcctactactggggctggatccgccagacccccgagcgcaacctcgagtggatcggcatcatctacttctccggcaccacctactacaacccctccctccagtcccgcgtctccatgtccctcgaccgctccaccaaccgcttctccctccgcctctcctccgtcaccgccgccgacaccgccatctactactgcgccaagcccaagtcccgcgaccgcggcggccccggcgacgactacttcggcatggacgtctggggccagggcatcatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcggcggcggctccggccaccaccaccaccaccaccaccaccaccacggcggcgactacaaggaccacgacggcgactacaaggaccacgacatcgactacaaggacgacgacgacaag

SEQ ID NO: 16407 - RNA, 810 nt, synthetic construct; identical to SEQ ID NO: 16406
  misc_feature 1..810: note = derived and/or modified sequence opt2 from anti-IsdB_5D1Z_Chain-F
  source 1..810: mol_type = other RNA

SEQ ID NO: 16408 - RNA, 792 nt, synthetic construct; identical to SEQ ID NO: 16404
  misc_feature 1..792: note = derived and/or modified sequence opt2 from anti-IsdB_5D1Z_Chain-G
  source 1..792: mol_type = other RNA

SEQ ID NO: 16409 - RNA, 642 nt, synthetic construct
  misc_feature 1..642: note = derived and/or modified sequence opt2 from anti-IsdB_5D1Z_HeavyChain
  source 1..642: mol_type = other RNA
gacatccagatgacccagtccccctccttcctctccgcctccgtcggcgaccgcgtcaccatcacctgccgcgcctcccagggcatcaccacctacctcggctggtaccagcagcgccccggcaaggccccccagctcctcatctacgccgcctcctccctccagtccggcgtccccccccgcttctccggctccggctccggcaccgagttcaccctcaccatctcctccctccagcccgaggacttcgccacctactactgccagcagctcaacacctacccctacaccttcggccccggcacccgcctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16410 - RNA, 471 nt, synthetic construct
  misc_feature 1..471: note = derived and/or modified sequence opt2 from anti-IsdB_5D1Z_Chain-I
  source 1..471: mol_type = other RNA
ggccccgccaaggccaccaacaacacctaccccatcctcaaccaggagctccgcgaggccatcaagaaccccgccatcaaggacaaggaccactccgcccccaactcccgccccatcgacttcgagatgaagaagaaggacggcacccagcagttctaccactacgcctcctccgtcaagcccgcccgcgtcatcttcaccgactccaagcccgagatcgagctcggcctccagtccggccagttctggcgcaagttcgaggtctacgagggcgacaagaagctccccatcaagctcgtctcctacgacaccgtcaaggactacgcctacatccgcttctccgtctccaacggcaccaaggccgtcaagatcgtctcctccacccacttcaacaacaaggaggagaagtacgactacaccctcatggagttcgcccagcccatctacaactccgccgacaagttcaagacc

SEQ ID NO: 16411 - RNA, 324 nt, synthetic construct
  misc_feature 1..324: note = derived and/or modified sequence opt2 from anti-HIV_b12_LightChain
  source 1..324: mol_type = other RNA
gagatcgtcctcacccagtcccccggcaccctctccctctcccccggcgagcgcgccaccttctcctgccgctcctcccactccatccgctcccgccgcgtcgcctggtaccagcacaagcccggccaggccccccgcctcgtcatccacggcgtctccaaccgcgcctccggcatctccgaccgcttctccggctccggctccggcaccgacttcaccctcaccatcacccgcgtcgagcccgaggacttcgccctctactactgccaggtctacggcgcctcctcctacaccttcggccagggcaccaagctcgagcgcaag

SEQ ID NO: 16412 - RNA, 381 nt, synthetic construct
  misc_feature 1..381: note = derived and/or modified sequence opt2 from anti-HIV_b12_HeavyChain
  source 1..381: mol_type = other RNA
caggtccagctcgagcagtccggcgccgaggtcaagaagcccggcgcctccgtcaaggtctcctgccaggcctccggctaccgcttctcccacttcaccgtccactgggtccgccaggcccccggccagcgcttcgagtggatgggctggatcaacccctacaacggcaacaaggagttctccgccaagttccaggaccgcgtcaccttcaccgccgacacctccgccaacaccgcctacatggagctccgctccctccgctccgccgacaccgccgtctactactgcgcccgcgtcggcgagtggggctgggacgactccccctacgacaactactacatggacgtctggggcaagggcaccaccgtcatcgtctcctcc

SEQ ID NO: 16413 - RNA, 633 nt, synthetic construct
  misc_feature 1..633: note = derived and/or modified sequence opt2 from anti-HIV_2G12_LightChain
  source 1..633: mol_type = other RNA
gtcgtcatgacccagtccccctccaccctctccgcctccgtcggcgacaccatcaccatcacctgccgcgcctcccagtccatcgagacctggctcgcctggtaccagcagaagcccggcaaggcccccaagctcctcatctacaaggcctccaccctcaagaccggcgtcccctcccgcttctccggctccggctccggcaccgagttcaccctcaccatctccggcctccagttcgacgacttcgccacctaccactgccagcactacgccggctactccgccaccttcggccagggcacccgcgtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggc

SEQ ID NO: 16414 - RNA, 672 nt, synthetic construct
  misc_feature 1..672: note = derived and/or modified sequence opt2 from anti-HIV_2G12_HeavyChain
  source 1..672: mol_type = other RNA
gaggtccagctcgtcgagtccggcggcggcctcgtcaaggccggcggctccctcatcctctcctgcggcgtctccaacttccgcatctccgcccacaccatgaactgggtccgccgcgtccccggcggcggcctcgagtgggtcgcctccatctccacctcctccacctaccgcgactacgccgacgccgtcaagggccgcttcaccgtctcccgcgacgacctcgaggacttcgtctacctccagatgcacaagatgcgcgtcgaggacaccgccatctactactgcgcccgcaagggctccgaccgcctctccgacaacgaccccttcgacgcctggggccccggcaccgtcgtcaccgtctcccccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 16415 - RNA, 642 nt, synthetic construct
  misc_feature 1..642: note = derived and/or modified sequence opt2 from anti-HIV_4E10_LightChain
  source 1..642: mol_type = other RNA
gagatcgtcctcacccagtcccccggcacccagtccctctcccccggcgagcgcgccaccctctcctgccgcgcctcccagtccgtcggcaacaacaagctcgcctggtaccagcagcgccccggccaggccccccgcctcctcatctacggcgcctcctcccgcccctccggcgtcgccgaccgcttctccggctccggctccggcaccgacttcaccctcaccatctcccgcctcgagcccgaggacttcgccgtctactactgccagcagtacggccagtccctctccaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgag

SEQ ID NO: 16416 - RNA, 684 nt, synthetic construct
  misc_feature 1..684: note = derived and/or modified sequence opt2 from anti-HIV_4E10_HeavyChain
  source 1..684: mol_type = other RNA
caggtccagctcgtccagtccggcgccgaggtcaagcgccccggctcctccgtcaccgtctcctgcaaggcctccggcggctccttctccacctacgccctctcctgggtccgccaggcccccggccgcggcctcgagtggatgggcggcgtcatccccctcctcaccatcaccaactacgccccccgcttccagggccgcatcaccatcaccgccgaccgctccacctccaccgcctacctcgagctcaactccctccgccccgaggacaccgccgtctactactgcgcccgcgagggcaccaccggctggggctggctcggcaagcccatcggcgccttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 16417 - RNA, 312 nt, synthetic construct
  misc_feature 1..312: note = derived and/or modified sequence opt2 from anti-HIV_VRC01_LightChain
  source 1..312: mol_type = other RNA
gagatcgtcctcacccagtcccccggcaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggccccgactacaacctcaccatctccaacctcgagtccggcgacttcggcgtctactactgccagcagtacgagttcttcggccagggcaccaaggtccaggtcgacatcaagcgc

SEQ ID NO: 16418 - RNA, 363 nt, synthetic construct
  misc_feature 1..363: note = derived and/or modified sequence opt2 from anti-HIV_VRC01_HeavyChain
  source 1..363: mol_type = other RNA
caggtccagctcgtccagtccggcggccagatgaagaagcccggcgagtccatgcgcatctcctgccgcgcctccggctacgagttcatcgactgcaccctcaactggatccgcctcgcccccggcaagcgccccgagtggatgggctggctcaagccccgcggcggcgccgtcaactacgcccgccccctccagggccgcgtcaccatgacccgcgacgtctactccgacaccgccttcctcgagctccgctccctcaccgtcgacgacaccgccgtctacttctgcacccgcggcaagaactgcgactacaactgggacttcgagcactggggccgcggcacccccgtcatcgtctcctcc

SEQ ID NO: 16419 - RNA, 330 nt, synthetic construct
  misc_feature 1..330: note = derived and/or modified sequence opt2 from anti-HIV_PG9_LightChain
  source 1..330: mol_type = other RNA
cagtccgccctcacccagcccgcctccgtctccggctcccccggccagtccatcaccatctcctgcaacggcacctccaacgacgtcggcggctacgagtccgtctcctggtaccagcagcaccccggcaaggcccccaaggtcgtcatctacgacgtctccaagcgcccctccggcgtctccaaccgcttctccggctccaagtccggcaacaccgcctccctcaccatctccggcctccaggccgaggacgagggcgactactactgcaagtccctcacctccacccgccgccgcgtcttcggcaccggcaccaagctcaccgtcctc

SEQ ID NO: 16420 - RNA, 408 nt, synthetic construct
  misc_feature 1..408: note = derived and/or modified sequence opt2 from anti-HIV_PG9_HeavyChain
  source 1..408: mol_type = other RNA
cagcgcctcgtcgagtccggcggcggcgtcgtccagcccggctcctccctccgcctctcctgcgccgcctccggcttcgacttctcccgccagggcatgcactgggtccgccaggcccccggccagggcctcgagtgggtcgccttcatcaagtacgacggctccgagaagtaccacgccgactccgtctggggccgcctctccatctcccgcgacaactccaaggacaccctctacctccagatgaactccctccgcgtcgaggacaccgccacctacttctgcgtccgcgaggccggcggccccgactaccgcaacggctacaactactacgacttctacgacggctactacaactaccactacatggacgtctggggcaagggcaccaccgtcaccgtctcctcc

SEQ ID NO: 16421 - RNA, 630 nt, synthetic construct
  misc_feature 1..630: note = derived and/or modified sequence opt2 from anti-HIV_VRC07_LightChain
  source 1..630: mol_type = other RNA
gagatcgtcctcacccagtcccccggcaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggccccgactacaccctcaccatctccaacctcgagtccggcgacttcggcgtctactactgccagcagtacgagttcttcggccagggcaccaaggtccaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctccgctcccccgtcaccaagtccttcaaccgcggcgagtgc

SEQ ID NO: 16422 - RNA, 375 nt, synthetic construct
  misc_feature 1..375: note = derived and/or modified sequence opt2 from anti-HIV_VRC07_HeavyChain
  source 1..375: mol_type = other RNA
caggtccagctcgtccagtccggcggccagatgaagaagcccggcgagtccatgcgcatctcctgccgcgcctccggctacgagttcatcgactgcaccctcaactggatccgcctcgcccccggcaagcgccccgagtggatgggctggctcaagccccgcggcggcgccgtcaactacgcccgccccctccagggccgcgtcaccatgacccgcgacgtctactccgacaccgccttcctcgagctccgctccctcacctccgacgacaccgccgtctacttctgcacccgcggcaagtactgcaccgcccgcgactactacaactgggacttcgagcactggggccagggcacccccgtcatcgtctcctcc

SEQ ID NO: 16423 - RNA, 315 nt, synthetic construct
  misc_feature 1..315: note = derived and/or modified sequence opt2 from anti-HIV_3BNC117_LightChain
  source 1..315: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgtcgtccccggcacccgcctcgacctcaagcgcaccgtcgccgccccc

SEQ ID NO: 16424 - RNA, 387 nt, synthetic construct
  misc_feature 1..387: note = derived and/or modified sequence opt2 from anti-HIV_3BNC117_HeavyChain
  source 1..387: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctccgcctccaccaagggcccc

SEQ ID NO: 16425 - RNA, 324 nt, synthetic construct
  misc_feature 1..324: note = derived and/or modified sequence opt2 from anti-HIV_10-1074_LightChain
  source 1..324: mol_type = other RNA
tcctacgtccgccccctctccgtcgccctcggcgagaccgcccgcatctcctgcggccgccaggccctcggctcccgcgccgtccagtggtaccagcaccgccccggccaggcccccatcctcctcatctacaacaaccaggaccgcccctccggcatccccgagcgcttctccggcacccccgacatcaacttcggcacccgcgccaccctcaccatctccggcgtcgaggccggcgacgaggccgactactactgccacatgtgggactcccgctccggcttctcctggtccttcggcggcgccacccgcctcaccgtcctc

SEQ ID NO: 16426 - RNA, 396 nt, synthetic construct
  misc_feature 1..396: note = derived and/or modified sequence opt2 from anti-HIV_10-1074_HeavyChain
  source 1..396: mol_type = other RNA
caggtccagctccaggagtccggccccggcctcgtcaagccctccgagaccctctccgtcacctgctccgtctccggcgactccatgaacaactactactggacctggatccgccagtcccccggcaagggcctcgagtggatcggctacatctccgaccgcgagtccgccacctacaacccctccctcaactcccgcgtcgtcatctcccgcgacacctccaagaaccagctctccctcaagctcaactccgtcacccccgccgacaccgccgtctactactgcgccaccgcccgccgcggccagcgcatctacggcgtcgtctccttcggcgagttcttctactactactccatggacgtctggggcaagggcaccaccgtcaccgtctcctcc

SEQ ID NO: 16427 - RNA, 633 nt, synthetic construct
  misc_feature 1..633: note = derived and/or modified sequence opt2 from anti-HIV_PGT121_LightChain
  source 1..633: mol_type = other RNA
tccgacatctccgtcgcccccggcgagaccgcccgcatctcctgcggcgagaagtccctcggctcccgcgccgtccagtggtaccagcaccgcgccggccaggccccctccctcatcatctacaacaaccaggaccgcccctccggcatccccgagcgcttctccggctcccccgactcccccttcggcaccaccgccaccctcaccatcacctccgtcgaggccggcgacgaggccgactactactgccacatctgggactcccgcgtccccaccaagtgggtcttcggcggcggcaccaccctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 16428 - RNA, 705 nt, synthetic construct
  misc_feature 1..705: note = derived and/or modified sequence opt2 from anti-HIV_PGT121_HeavyChain
  source 1..705: mol_type = other RNA
cagatgcagctccaggagtccggccccggcctcgtcaagccctccgagaccctctccctcacctgctccgtctccggcgcctccatctccgactcctactggtcctggatccgccgctcccccggcaagggcctcgagtggatcggctacgtccacaagtccggcgacaccaactactccccctccctcaagtcccgcgtcaacctctccctcgacacctccaagaaccaggtctccctctccctcgtcgccgccaccgccgccgactccggcaagtactactgcgcccgcaccctccacggccgccgcatctacggcatcgtcgccttcaacgagtggttcacctacttctacatggacgtctggggcaacggcacccaggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgc

SEQ ID NO: 16429 - RNA, 657 nt, synthetic construct
  misc_feature 1..657: note = derived and/or modified sequence opt2 from anti-HIV_PGDM1400_LightChain
  source 1..657: mol_type = other RNA
gacttcgtcctcacccagtccccccactccctctccgtcacccccggcgagtccgcctccatctcctgcaagtcctcccactccctcatccacggcgaccgcaacaactacctcgcctggtacgtccagaagcccggccgctccccccagctcctcatctacctcgcctcctcccgcgcctccggcgtccccgaccgcttctccggctccggctccgacaaggacttcaccctcaagatctcccgcgtcgagaccgaggacgtcggcacctactactgcatgcagggccgcgagtccccctggaccttcggccagggcaccaaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16430 - RNA, 735 nt, synthetic construct
  misc_feature 1..735: note = derived and/or modified sequence opt2 from anti-HIV_PGDM1400_HeavyChain
  source 1..735: mol_type = other RNA
caggcccagctcgtccagtccggccccgaggtccgcaagcccggcacctccgtcaaggtctcctgcaaggcccccggcaacaccctcaagacctacgacctccactgggtccgctccgtccccggccagggcctccagtggatgggctggatctcccacgagggcgacaagaaggtcatcgtcgagcgcttcaaggccaaggtcaccatcgactgggaccgctccaccaacaccgcctacctccagctctccggcctcacctccggcgacaccgccgtctactactgcgccaagggctccaagcaccgcctccgcgactacgccctctacgacgacgacggcgccctcaactgggccgtcgacgtcgactacctctccaacctcgagttctggggccagggcaccgccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgac

SEQ ID NO: 16431 - RNA, 630 nt, synthetic construct
  misc_feature 1..630: note = derived and/or modified sequence opt2 from anti-HIV_N6_LightChain
  source 1..630: mol_type = other RNA
tacatccacgtcacccagtccccctcctccctctccgtctccatcggcgaccgcgtcaccatcaactgccagacctcccagggcgtcggctccgacctccactggtaccagcacaagcccggccgcgcccccaagctcctcatccaccacacctcctccgtcgaggacggcgtcccctcccgcttctccggctccggcttccacacctccttcaacctcaccatctccgacctccaggccgacgacatcgccacctactactgccaggtcctccagttcttcggccgcggctcccgcctccacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16432 - RNA, 675 nt, synthetic construct
  misc_feature 1..675: note = derived and/or modified sequence opt2 from anti-HIV_N6_HeavyChain
  source 1..675: mol_type = other RNA
cgcgcccacctcgtccagtccggcaccgccatgaagaagcccggcgcctccgtccgcgtctcctgccagacctccggctacaccttcaccgcccacatcctcttctggttccgccaggcccccggccgcggcctcgagtgggtcggctggatcaagccccagtacggcgccgtcaacttcggcggcggcttccgcgaccgcgtcaccctcacccgcgacgtctaccgcgagatcgcctacatggacatccgcggcctcaagcccgacgacaccgccgtctactactgcgcccgcgaccgctcctacggcgactcctcctgggccctcgacgcctggggccagggcaccaccgtcgtcgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16433 - RNA, 1080 nt, synthetic construct
  misc_feature 1..1080: note = derived and/or modified sequence opt2 from anti-HIV_N6_GChain
  source 1..1080: mol_type = other RNA
gcctgggaggacgccgacaccaccctcttctgcgcctccgacgccaaggcctactccaccgagaagcacaacgtctgggccacccacgcctgcgtccccaccgaccccgacccccaggagatccccctcgagaacgtcaccgagaacttcaacatgtggaagaacaacatggtcgagcagatgcacgaggacatcatctccctctgggacgagtccctcaagccctgcgtcatgctcaccggcggctccaccatcaagcaggcctgccccaaggtcaccttcgagcccatccccatccactactgcgcccccgccggcttcgccatcctcaagtgccgcgacgaggacttcaacggcaccggcccctgcaagaacgtctccaccgtccagtgcacccacggcatcaagcccgtcgtctccacccagctcctcctcaacggctccctcgccaagggcgacatcgtcatccgctccgagaacctcaccaacaacgccaaggtcatcatcgtccagctcaacgagcccgtccagatcgtctgcatccgccccaacaacggcggctccggctccggcggcgacatccgccaggcccactgcaacgtcacccgcggcaagtgggtcaacatcaccaagaacgtcaaggagcagctctggaagatcttcaacaagaccaccaacatcaccttcaacaacaccatcttcaactcccccgccggcggcgacctcgagatcaccacccactccttcaactgcggcggcgagttcttctactgcaacacctccgacctcttcaacgagaccaacctctccgccaaccacaccgacaccaacgagaacatcaccctccagtgccgcatcaagcagatcgtccgcatgtggcagcgcgtcggccaggccatgtacgccccccccatcgccggcaacatcacctgcatctccaacatcaccggcctcctcctcacccgcgacggcgtcaacgacacccacgacaaggagaacgagaccttccgccccaccggcggcgacatgcgcgacaactggcgctccgagctctacaagtacaaggtcatcaagctcaag

SEQ ID NO: 16434 - RNA, 645 nt, synthetic construct
  misc_feature 1..645: note = derived and/or modified sequence opt2 from anti-HIV_10E8_LightChain
  source 1..645: mol_type = other RNA
tcctacgagctcacccaggagaccggcgtctccgtcgccctcggccgcaccgtcaccatcacctgccgcggcgactccctccgctcccactacgcctcctggtaccagaagaagcccggccaggcccccatcctcctcttctacggcaagaacaaccgcccctccggcgtccccgaccgcttctccggctccgcctccggcaaccgcgcctccctcaccatctccggcgcccaggccgaggacgacgccgagtactactgctcctcccgcgacaagtccggctcccgcctctccgtcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16435 - RNA, 708 nt, synthetic construct
  misc_feature 1..708: note = derived and/or modified sequence opt2 from anti-HIV_10E8_HeavyChain
  source 1..708: mol_type = other RNA
gaggtccagctcgtcgagtccggcggcggcctcgtcaagcccggcggctccctccgcctctcctgctccgcctccggcttcgacttcgacaacgcctggatgacctgggtccgccagccccccggcaagggcctcgagtgggtcggccgcatcaccggccccggcgagggctggtccgtcgactacgccgcccccgtcgagggccgcttcaccatctcccgcctcaactccatcaacttcctctacctcgagatgaacaacctccgcatggaggactccggcctctacttctgcgcccgcaccggcaagtactacgacttctggtccggctacccccccggcgaggagtacttccaggactggggccgcggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaag

SEQ ID NO: 16436 - RNA, 333 nt, synthetic construct
  misc_feature 1..333: note = derived and/or modified sequence opt2 from anti-HIV_12A12_LightChain
  source 1..333: mol_type = other RNA
gacatccagatgacccagtccccctcctccctctccgcctccgtcggcgaccgcgtcaccatcacctgccaggccggccagggcatcggctcctccctccagtggtaccagcagaagcccggcaaggcccccaagctcctcgtccacggcgcctccaacctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgagatcaagcgcaccgtcgccgccccctccgtc

SEQ ID NO: 16437 - RNA, 381 nt, synthetic construct
  misc_feature 1..381: note = derived and/or modified sequence opt2 from anti-HIV_12A12_HeavyChain
  source 1..381: mol_type = other RNA
tcccagcacctcgtccagtccggcacccaggtcaagaagcccggcgcctccgtccgcatctcctgccaggcctccggctactccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgccttcatggacctctccggcctccgctccgacgacaccgccctctacttctgcgcccgcgacggctccggcgacgacacctcctggcacctcgacccctggggccagggcaccctcgtcatcgtctccgccgcctccaccaagggc

SEQ ID NO: 16438 - RNA, 315 nt, synthetic construct
  misc_feature 1..315: note = derived and/or modified sequence opt2 from anti-HIV_12A21_LightChain
  source 1..315: mol_type = other RNA
gacatccagatgacccagtccccctcctccctctccgcctccgtcggcgaccgcgtcaccatcaactgccaggccggccagggcatcggctcctccctcaactggtaccagaagaagcccggccgcgcccccaagctcctcgtccacggcgcctccaacctccagcgcggcgtcccctcccgcttctccggctccggcttccacaccaccttcaccctcaccatctcctccctccagcccgacgacgtcgccacctacttctgcgccgtcttccagtggttcggccccggcaccaaggtcgacatcaagcgcacc

SEQ ID NO: 16439 - RNA, 384 nt, synthetic construct
  misc_feature 1..384: note = derived and/or modified sequence opt2 from anti-HIV_12A21_HeavyChain
  source 1..384: mol_type = other RNA
tcccagcacctcgtccagtccggcacccaggtcaagaagcccggcgcctccgtccgcgtctcctgccaggcctccggctacaccttcaccaactacatcctccactggtggcgccaggcccccggccagggcctcgagtggatgggcctcatcaagcccgtcttcggcgccgtcaactacgcccgccagttccagggccgcatccagctcacccgcgacatctaccgcgagatcgccttcctcgacctctccggcctccgctccgacgacaccgccgtctactactgcgcccgcgacgagtccggcgacgacctcaagtggcacctccacccctggggccagggcacccaggtcatcgtctcccccgcctccaccaagggcccc

SEQ ID NO: 16440 - RNA, 648 nt, synthetic construct
  misc_feature 1..648: note = derived and/or modified sequence opt2 from anti-HIV_35022_LightChain
  source 1..648: mol_type = other RNA
cagtccgtcctcacccagtccgcctccgtctccggctccctcggccagtccgtcaccatctcctgcaccggccccaactccgtctgctgctcccacaagtccatctcctggtaccagtggccccccggccgcgcccccaccctcatcatctacgaggacaacgagcgcgcccccggcatctccccccgcttctccggctacaagtcctactggtccgcctacctcaccatctccgacctccgccccgaggacgagaccacctactactgctgctcctacacccacaactccggctgcgtcttcggcaccggcaccaaggtctccgtcctcggccagtccaaggccaacccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16441 - RNA, 729 nt, synthetic construct
  misc_feature 1..729: note = derived and/or modified sequence opt2 from anti-HIV_35022_HeavyChain
  source 1..729: mol_type = other RNA
gagggccagctcgtccagtccggcgccgagctcaagaagcccggcgcctccgtcaagatctcctgcaagacctccggctaccgcttcaacttctaccacatcaactggatccgccagaccgccggccgcggccccgagtggatgggctggatctccccctactccggcgacaagaacctcgcccccgccttccaggaccgcgtcatcatgaccaccgacaccgaggtccccgtcacctccttcacctccaccggcgccgcctacatggagatccgcaacctcaagttcgacgacaccggcacctacttctgcgccaagggcctcctccgcgacggctcctccacctggctcccctacctctggggccagggcaccctcctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagggcctcgaggtcctcttccag

SEQ ID NO: 16442 - RNA, 648 nt, synthetic construct
  misc_feature 1..648: note = derived and/or modified sequence opt2 from anti-HIV_3BC176_LightChain
  source 1..648: mol_type = other RNA
cagtccgtcctcacccagcccgcctccgtctccgcctcccccggccagtccatcaccgtctcctgcaccggctcccgcaacgacgtcggcggctacgacttcgtctcctggtaccagcgccaccccggcggcgtccccaagctcatcatctacgagatctccaagcgcccctccggcatcccccagcgcttctccggctcccgctccggcaacaccgcctccctcaccatctccggcctccaggacgacgacgaggccgactactactgctgctcctacgcctcctacgaccgcctcatcttcggcggcggcacccgcgtctccgtcctccgccagcccaaggccgccccctccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16443 - RNA, 699 nt, synthetic construct
  misc_feature 1..699: note = derived and/or modified sequence opt2 from anti-HIV_3BC176_HeavyChain
  source 1..699: mol_type = other RNA
gagcaggtccagctcatgcagtccggcgcccagctccgcgaccccggcgactccctcaagatctcctgcaaggcctccggctacaacttcatcgactaccacatccactgggtccgcctcgcccccggccgcggcctcgagtggatgggctggatcgaccccgtcggcggcatcaccaagtacgccggccagttccagggccgcctctccctcacccgcgacacctccaccaacaccctcttcctcgagctctcccgcctcaccgccggcgacaccgccgtctacttctgcgcccgctccatgcgccccgtcgaccacggcatcgactactccggcctcttcgtcttccacttctggggccgcggctccgacgtcctcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgac

SEQ ID NO: 16444 - RNA, 621 nt, synthetic construct
  misc_feature 1..621: note = derived and/or modified sequence opt2 from anti-HIV_3BNC55_LightChain
  source 1..621: mol_type = other RNA
gacatccagatgacccagtccccctcctccctctccgcctccgtcggcgacaaggtcaccatcacctgccagacctccgccggctacctcaactggtaccagcagcgccgcggccgcgcccccaagctcctcatgtacgacggctcccgcctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16445 - RNA, 675 nt, synthetic construct
  misc_feature 1..675: note = derived and/or modified sequence opt2 from anti-HIV_3BNC55_HeavyChain
  source 1..675: mol_type = other RNA
caggtccagctcgtccagtccggcaccgccgtcaagcgccccggcgcctccgtccgcgtctcctgccaggcctccggctacaccttcaccgactacttcatctactggtggcgccaggcccccggccagggcctcgagtggctcggctggatcaaccccctcacctcccagccctcctacccctcccgcttccagggccgcctcaccctcacccgcgacaccttcgacgagatgctctacatggacctccgcggcctccgctccgacgacaccggcatctacttctgcgcccgccgccactccgactactgcgacttcgacatctggggctccggcacccagatcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacc

SEQ ID NO: 16446 - RNA, 618 nt, synthetic construct
  misc_feature 1..618: note = derived and/or modified sequence opt2 from anti-HIV_3BNC60_LightChain
  source 1..618: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagcgcggcgtccccgcccgcttctccggccgccgctggggccaggagtacaacctcaccatcaacaacctccagcccgaggacgtcgccacctacttctgccaggtctacgagttcatcgtccccggcacccgcctcgacctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16447 - RNA, 687 nt, synthetic construct
  misc_feature 1..687: note = derived and/or modified sequence opt2 from anti-HIV_3BNC60_HeavyChain
  source 1..687: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcgtctccctcacccgccaggcctcctgggacttcgacacctactccttctacatggacctcaaggccgtccgctccgacgacaccgccatctacttctgcgcccgccagcgctccgacttctgggacttcgacgtctggggctccggcacccaggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacc

SEQ ID NO: 16448 - RNA, 687 nt, synthetic construct
  misc_feature 1..687: note = derived and/or modified sequence opt2 from anti-HIV_3BNC60_HeavyChain
  source 1..687: mol_type = other RNA
gaggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacgcccgccagttccagggccgcgtctccctcacccgccaggcctcctgggacttcgacacctactccttctacatggacctcaaggccgtccgctccgacgacaccgccatctacttctgcgcccgccagcgctccgacttctgggacttcgacgtctggggctccggcacccaggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacc

SEQ ID NO: 16449 - RNA, 648 nt, synthetic construct
  misc_feature 1..648: note = derived and/or modified sequence opt2 from anti-HIV_447-52D_LightChain
  source 1..648: mol_type = other RNA
cagtccgtcctcacccagcccccctccgtctccgccgcccccggccagaaggtcaccatctcctgctccggctcctcctccaacatcggcaacaactacgtcctctggtaccagcagttccccggcaccgcccccaagctcctcatctacggcaacaacaagcgcccctccggcatccccgaccgcttctccggctccaagtccggcacctccgccaccctcggcatcaccggcctccagaccggcgacgaggccgactacttctgcgccacctgggactccggcctctccgccgactgggtcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgc

SEQ ID NO: 16450 - RNA, 693 nt, synthetic construct
  misc_feature 1..693: note = derived and/or modified sequence opt2 from anti-HIV_447-52D_HeavyChain
  source 1..693: mol_type = other RNA
gaggtccagctcgtcgagtccggcggcggcctcgtcaagcccggcggctccctccgcctcacctgcgtcgcctccggcttcaccttctccgacgtctggctcaactgggtccgccaggcccccggcaagggcctcgagtgggtcggccgcatcaagtcccgcaccgacggcggcaccaccgactacgccgcctccgtcaagggccgcttcaccatctcccgcgacgactccaagaacaccctctacctccagatgaactccctcaagaccgaggacaccgccgtctactcctgcaccaccgacggcttcatcatgatccgcggcgtctccgaggactactactactactacatggacgtctggggcaagggcaccaccgtcaccgtctcctccgcctccaccaagggcccctccgtcttccccctcgccccctgctcccgctccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacacctgcaacgtcaaccacaagccctccaacaccaaggtcgacaagcgcgtcgagctc

SEQ ID NO: 16451 - RNA, 645 nt, synthetic construct
  misc_feature 1..645: note = derived and/or modified sequence opt2 from anti-HIV_447-52D_LightChain
  source 1..645: mol_type = other RNA
cagtccgtcctcacccagcccccctccgtctccgccgcccccggccagaaggtcaccatctcctgctccggctcctcctccaacatcggcaacaactacgtcctctggtaccagcagttccccggcaccgcccccaagctcctcatctacggcaacaacaagcgcccctccggcatccccgaccgcttctccggctccaagtccggcacctccgccaccctcggcatcaccggcctccagaccggcgacgaggccgactacttctgcgccacctgggactccggcctctccgccgactgggtcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgag

SEQ ID NO: 16452 - RNA, 705 nt, synthetic construct
  misc_feature 1..705: note = derived and/or modified sequence opt2 from anti-HIV_447-52D_HeavyChain
  source 1..705: mol_type = other RNA
gaggtccagctcgtcgagtccggcggcggcctcgtcaagcccggcggctccctccgcctcacctgcgtcgcctccggcttcaccttctccgacgtctggctcaactgggtccgccaggcccccggcaagggcctcgagtgggtcggccgcatcaagtcccgcaccgacggcggcaccaccgactacgccgcctccgtcaagggccgcttcaccatctcccgcgacgactccaagaacaccctctacctccagatgaactccctcaagaccgaggacaccgccgtctactcctgcaccaccgacggcttcatcatgatccgcggcgtctccgaggactactactactactacatggacgtctggggcaagggcaccaccgtcaccgtctcctccgcctccaccaagggcccctccgtcttccccctcgccccctgctcccgctccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacacctgcaacgtcaaccacaagccctccaacaccaaggtcgacaagcgcgtcgagctcaagacccccacc

SEQ ID NO: 16453 - RNA, 624 nt, synthetic construct
  misc_feature 1..624: note = derived and/or modified sequence opt2 from anti-HIV_5H/I1-BMV-D5_LightChain
  source 1..624: mol_type = other RNA
gacatccagatgacccagtccccctccaccctctccgcctccatcggcgaccgcgtcaccatcacctgccgcgcctccgagggcatctaccactggctcgcctggtaccagcagaagcccggcaaggcccccaagctcctcatctacaaggcctcctccctcgcctccggcgccccctcccgcttctccggctccggctccggcaccgacttcaccctcaccatctcctccctccagcccgacgacttcgccacctactactgccagcagtactccaactaccccctcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtcc

SEQ ID NO: 16454 - RNA, 651 nt, synthetic construct
  misc_feature 1..651: note = derived and/or modified sequence opt2 from anti-HIV_5H/I1-BMV-D5_HeavyChain
  source 1..651: mol_type = other RNA
caggtccagctcgtccagtccggcgccgaggtccgcaagcccggcgcctccgtcaaggtctcctgcaaggcctccggcgacaccttctcctcctacgccatctcctgggtccgccaggcccccggccagggcctcgagtggatgggcggcatcatccccatcttcggcaccgccaactacgcccaggccttccagggccgcgtcaccatcaccgccaacgagtccacctccaccgcctacatggagctctcctccctccgctccgaggacaccgccatctactactgcgcccgcgacaaccccaccctcctcggctccgactactggggcgccggcaccctcgtcaccgtctcctccgcctccaccaagggcccctccgtcttccccctcgccccctgctcccgctccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtc

SEQ ID NO: 16455 - RNA, 657 nt, synthetic construct
  misc_feature 1..657: note = derived and/or modified sequence opt2 from anti-HIV_5H/I1-BMV-D5_A-Chain
  source 1..657: mol_type = other RNA
atgcagctcctctccggcatcgtccagcagcagaacaacctcctccgcgccatcgaggcccagcagcacctcctccagctcaccgtctggggcatcaagcagctccaggcccgcatcctcgccggcggctccggcggccacaccacctggatggagtgggaccgcgagatcaacaactacacctccctcatccactccctcatcgaggagtcccagaaccagcaggagaagaacgagcaggagctcctcgagggctcctccggcggccagctcctctccggcatcgtccagcagcagaacaacctcctccgcgccatcgaggcccagcagcacctcctccagctcaccgtctggggcatcaagcagctccaggcccgcatcctcgccggcggctccggcggccacaccacctggatggagtgggaccgcgagatcaacaactacacctccctcatccactccctcatcgaggagtcccagaaccagcaggagaagaacgagcaggagctcctcgagggctcctccggcggccagctcctctccggcatcgtccagcagcagaacaacctcctccgcgccatcgaggcccagcagcacctcctccagctcaccgtctggggcatcaagcagctccaggcccgcatcctcgccggcggc

SEQ ID NO: 16456 - RNA, 390 nt, synthetic construct
  misc_feature 1..390: note = derived and/or modified sequence opt2 from anti-HIV_8ANC195_LightChain
  source 1..390: mol_type = other RNA
gacatccagatgacccagtccccctccaccctctccgcctccatcggcgacaccgtccgcatctcctgccgcgcctcccagtccatcaccggcaactgggtcgcctggtaccagcagcgccccggcaaggccccccgcctcctcatctaccgcggcgccgccctcctcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttcatcttccccccctccgacgagcagctcaagtccggcacc

SEQ ID NO: 16457 - RNA, 423 nt, synthetic construct
  misc_feature 1..423: note = derived and/or modified sequence opt2 from anti-HIV_8ANC195_HeavyChain
  source 1..423: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgacaagtggtccggcctccaccacgacggcgtcatggccttctcctcctggggccagggcaccctcatctccgtctccgccgcctccaccaagggcccctccgtcttc

SEQ ID NO: 16458 - RNA, 333 nt, synthetic construct
  misc_feature 1..333: note = derived and/or modified sequence opt2 from anti-HIV_CAP256-VRC26.01_LightChain
  source 1..333: mol_type = other RNA
cagtccgtcctcacccagcccccctccgtctccgccgcccccggccagaaggtcaccatctcctgctccggctcctcctccaccatcggcaacaactacgtctcctggtaccgcctcctccccggcaccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 16459 - RNA, 432 nt, synthetic construct
  misc_feature 1..432: note = derived and/or modified sequence opt2 from anti-HIV_CAP256-VRC26.01_HeavyChain
  source 1..432: mol_type = other RNA
gaggtccaggtcgtcgagtccggcggcggcgtcgtccagcccggccgctccctccgcctctcctgcaccgcctccggcttcaccttctccaacttcgccatgggctgggtccgccaggcccccggcaagggcctcgagtgggtcgccttcatctcctccgacggctccaacaagaactacggcgactccgtcaagggccgcttcaccatctcccgcgacaactccaagaacaccgtcttcctccagatgaactccctccgcgtcgaggacaccgccctctactactgcgccaaggacgtcggcgactacaagtccgacgagtggggcaccgagtactacgacatctccatctcctaccccatccaggacccccgcgccatggtcggcgccttcgacctctggggccagggcaccatggtcaccgtctccccc

SEQ ID NO: 16460 - RNA, 324 nt, synthetic construct
  misc_feature 1..324: note = derived and/or modified sequence opt2 from anti-HIV_CAP256-VRC26.02_LightChain
  source 1..324: mol_type = other RNA
cagtccgtcctcacccagcccccctccgtctccgccgcccccggccagaaggtcaccatctcctgctccggctccaactccaacatcggcaacaaggacgtctcctggtaccagcagatccccgccaccgcccccaagctcctcatctacgagaacaacaagcgcccctccggcatctccgaccgcttctccggctccaagtccggcacctccgccaccctcgccatcaccggcctccagaccggcgacgaggccgactactactgcgccacctgggacggccgcgtctccgtcatcggcaccggcaccaacgtcatcgtcctc

SEQ ID NO: 16461 - RNA, 432 nt, synthetic construct
  misc_feature 1..432: note = derived and/or modified sequence opt2 from anti-HIV_CAP256-VRC26.02_HeavyChain
  source 1..432: mol_type = other RNA
gaggtccagctcgtcgagtccggcggcggcgtcgtccagcccggccgctccctccgcctctcctgcgccgcctcccagttctccttcggcaactacggcatgcactgggtccgccaggcccccggcaagggcctcgagtgggtcgccgccatctccttcgccggcaccaagaccaactacgccgactccgtcaagggccgcttcaccatctcccgcgacaactccaagaacaccgtctacctccagatgaactccctccgcgccgaggacaccgccctctacttctgcgccaaggacatccgcgagtacgagtgcgagtactggacctccgactactacgacttcggccgcccccagccctgcatcgactcccgcggcgtcgtcggcaccttcgacgtctggggccagggcaccatggtcaccgtctcctcc

SEQ ID NO: 16462 - RNA, 333 nt, synthetic construct
  misc_feature 1..333: note = derived and/or modified sequence opt2 from anti-HIV_CAP256-VRC26.03_LightChain
  source 1..333: mol_type = other RNA
cagtccgtcctcacccagcccccctccgtctccgccgcccccggccagaaggtcaccatctcctgctccggctcctcctccaacatcggcaacaacttcgtctcctggtaccagcagcgccccggcaccgcccccaagatcctcatctacgagaacaacaagcgcccctccgagacccccgaccgcttctccggctccaagtccggcacctccgccaccctcgccatcaccggcctccagaccgccgacgaggccgagtactactgcgccacctggtccgcctccctctcctccgcccgcgtcttcggcaccggcacccgcatcaccgtcctc

SEQ ID NO: 16463 - RNA, 432 nt, synthetic construct
  misc_feature 1..432: note = derived and/or modified sequence opt2 from anti-HIV_CAP256-VRC26.03_HeavyChain
  source 1..432: mol_type = other RNA
gaggtccagctcgtcgagtccggcggcggcgtcgtccagcccggcaagtccctccgcctctcctgcgccgcctcccgcttctccttcaaccgctacggcatgcactgggtccgccaggcccccggcaagggcctcgagtgggtcgccgccatctcctacgacggcaccgacaagtaccacgccgacaaggtctggggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggcaagcagctcccctgccgcaagtcccgcggcgtcgccggcatcttcgacggctggggccagggcaccatggtcaccgtctcctcc

SEQ ID NO: 16464 - RNA, 333 nt, synthetic construct
  misc_feature 1..333: note = derived and/or modified sequence opt2 from anti-HIV_CAP256-VRC26.04_LightChain
  source 1..333: mol_type = other RNA
cagcccgtcctcacccagcccccctccgtctccgccgcccccggccagaaggtcaccatctcctgctccggctcctcctccaacatcggcaacaacttcgtctcctggtaccagcagcgccccggcaccgccccctccctcctcatctacgagaccaacaagcgcccctccggcatccccgaccgcttctccggctccaagtccgccacctccgccaccctcgccatcaccggcctccagaccggcgacgaggccgactactactgcgccacctgggccgcctccctcacctccgcccgcgtcttcggcaccggcaccaaggtcatcgtctcc

SEQ ID NO: 16465 - RNA, 432 nt, synthetic construct
  misc_feature 1..432: note = derived and/or modified sequence opt2 from anti-HIV_CAP256-VRC26.04_HeavyChain
  source 1..432: mol_type = other RNA
gaggtccagctcgtcgagtccggcggcggcgtcgtccagcccggcaagtccctccgcctctcctgcgccgcctcccagttctccttcaaccgctacggcatgcactgggtccgccaggcccccggcaagggcctcgagtgggtcgccgccatctcctacgacggcaccgacaagtaccacgccgacaaggtctggggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggcaagcagctcccctgccgcaagtcccgcggcgtcgccggcatcttcgacaagtggggccagggcaccatggtcatcgtctcctcc

SEQ ID NO: 16466 - RNA, 324 nt, synthetic construct
  misc_feature 1..324: note = derived and/or modified sequence opt2 from anti-HIV_CAP256-VRC26.05_LightChain
  source 1..324: mol_type = other RNA
cagtccgccctcacccagcccccctccgtctccgccgcccccggccagaaggtcaccatctcctgctccggcaacatcggcaacaactacgtctcctggtaccagcaggtccccggcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctggggcggctccctccgcaccggcggcgtcctcggcaccggcacccgcgtcaccgtcctc

SEQ ID NO: 16467 - RNA, 432 nt, synthetic construct
  misc_feature 1..432: note = derived and/or modified sequence opt2 from anti-HIV_CAP256-VRC26.05_HeavyChain
  source 1..432: mol_type = other RNA
gaggtccagctcgtcgagtccggcggcggcgtcgtccagcccggccgctccctccgcctctcctgcgccgcctcccacttctccctctcctcctacggcatgcactgggtccgccaggcccccggcaagggcctcgagtgggtcaccggcatctccttcgccggcaccaagacctactacggcgactccgtccgcggccgcttcaccgtctcccgcgacatctccaagaacaccctcttcctccagatgaactccctccgccccgacgacaccgccatgtactactgcgcccgcgaccagcgctactacgagtgcgaggagtgggcctccgactactacgacttcggccgcgagcagccctgcctcgacccccgcggcgtcgtcggcatcttcgacctctggggccagggcaccatggtcaccgtctcctcc

SEQ ID NO: 16468 - RNA, 324 nt, synthetic construct
  misc_feature 1..324: note = derived and/or modified sequence opt2 from anti-HIV_CAP256-VRC26.06_LightChain
  source 1..324: mol_type = other RNA
cagtccgtcctcacccagcccccctccgtctccgccgcccccggccagaaggtcaccatctcctgctccggctccacctccaagatcggccagaactccgtctcctggtaccagcagctccccggcaccgcccccaagctcctcatctacgagaacgaccgccgcccctccggcacccccgaccgcttctccggctccaagtccggcacctccgccaccctcgccatcaccggcctccagaccggcgacgaggccgagtactactgcgagacctgggacggctccggcggcgtcttcggcaccggcaccaaggtcaccgtcctc

SEQ ID NO: 16469 - RNA, 435 nt, synthetic construct
  misc_feature 1..435: note = derived and/or modified sequence opt2 from anti-HIV_CAP256-VRC26.06_HeavyChain
  source 1..435: mol_type = other RNA
gaggtccagctcatcgagtccggcggcggcgtcgtccagcccggccgctccctccgcctctcctgcggcgcctccggcttctccttcaacaactacggcatgcactgggtccgccaggcccccggcaagggcctcgagtgggtcgccggcatctccttcgccggcatcaagaagtactacggcacctccgtcaagggccgcttcaccatctcccgcgacaactccaagaacaacttctacctccagatgaactccctccgcgtcgaggacaccgccctctactactgcgcccgcgacctccgcgagctcgagtgcgaggagtggaccctctacaactactacgacttcggctcccgcggcccctgcgtcgacccccgcggcgtcgccggctccttcgacgtctggggccagggcaccatggtcaccgtctcctcc

SEQ ID NO: 16470 - RNA, 333 nt, synthetic construct
  misc_feature 1..333: note = derived and/or modified sequence opt2 from anti-HIV_CAP256-VRC26.07_LightChain
  source 1..333: mol_type = other RNA
caggccgtcctcacccagcccccctccgtctccgccgcccccggccagaacgtcaccatctcctgctccggctccggctccaacatcggcaacaacttcgtctcctggtaccagcagcgccccggcaccgcccccaagctcctcatctacgagtccaacaagcgcccctccggcatccccgaccgcttctccggctccaagtccggcacctccgccaccctcgccatcaccggcctccagaccggcgacgaggcctactactactgcgccacctgggccgcccgcctcaactccgcccgcgtcttcggcaccggcaccatggtcaccgtcctc

SEQ ID NO: 16471 - RNA, 432 nt, synthetic construct
  misc_feature 1..432: note = derived and/or modified sequence opt2 from anti-HIV_CAP256-VRC26.07_HeavyChain
  source 1..432: mol_type = other RNA
gaggtccagctcgtcgagtccggcggcggcgtcgtccagcccggccgctccctccgcctctcctgcgtcggctcccagttctccttcaaccgctacggcatgcactgggtccgccaggcccccggcaagggcctcgagtgggtcgccggcatctccttcgacggcaccgaccgctaccacgccgacaacgtctggggccgcttcaccatctcccgcgacaactccaagaacaccctctacctccagatgtcctccctccgcgccgaggacaccgccctctactactgcgccaaggacctccgcgaggacgagtgcgaggagtggtggtccgactactacgacttcggcaagaagctcccctgccgcaagtcccgcggcgtcgccggcgtcttcgacaagtggggccagggcaccatggtcaccgtctcctcc

SEQ ID NO: 16472 - RNA, 333 nt, synthetic construct
  misc_feature 1..333: note = derived and/or modified sequence opt2 from anti-HIV_CAP256-VRC26.08_LightChain
  source 1..333: mol_type = other RNA
cagtccgccctcacccagcccccctccgtctccgccgcccccggccagaaggtcaccatctcctgctccggcaactcctccaacatcggcaacaacttcgtctcctggtaccagcaggtccccggcaccgcccccaagctcctcctctacgagacctaccgccgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 16473 - RNA, 438 nt, synthetic construct
  misc_feature 1..438: note = derived and/or modified sequence opt2 from anti-HIV_CAP256-VRC26.08_HeavyChain
  source 1..438: mol_type = other RNA
gaggtccagctcgtcgagtccggcggcggcgtcgtccagcccggccgctccctcaccctctcctgcgccgcctcccagttcaccttctccaactacggcatgcactgggtccgccaggcccccggcaagggcctcgagtgggtcgcctccgtctccaacgacggcaccaagaagtaccacggcgactccgtctggggccgcttcaccatctcccgcgacaactccaagaacaccctcttcctccagatgtcctccctccgcgccgaggacaccgccgtctacttctgcgtccgcgaccagcgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 16474 - RNA, 333 nt, synthetic construct
  misc_feature 1..333: note = derived and/or modified sequence opt2 from anti-HIV_CAP256-VRC26.09_LightChain
  source 1..333: mol_type = other RNA
cagtccgccctcacccagcccccctccgtctccgccgcccccggccagaaggtcaccatctcctgctccggcaactcctccaacatcggcaacaacttcgtctcctggtaccagcagctccccggcaccgcccccaagctcctcatctacgagaacaaccgccgcccctccggcatccccgaccgcttctccggctccaagtccggcacctccgccaccctcgccatctccggcctccagaccggcgacgaggccgactactggtgcgccgtctggggcgtccgccgcggcgccggcgccgtcttcggcgccggcaccaaggtcaccgtcctc

SEQ ID NO: 16475 - RNA, 438 nt, synthetic construct
  misc_feature 1..438: note = derived and/or modified sequence opt2 from anti-HIV_CAP256-VRC26.09_HeavyChain
  source 1..438: mol_type = other RNA
gaggtccagctcgtcgagtccggcggcggcgtcgtccagcccggccgctccctcaccctctcctgcgccgcctcccagttcaacttcgccaactacggcatgcactgggtccgccaggcccccggcaagggcctcgagtgggtcgcctccatctccaacgacggcaccaagaagtaccacgaggagtccgtctggggccgcttcaccatctccaaggacaactccaagtccaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 16476 - RNA, 333 nt, synthetic construct
  misc_feature 1..333: note = derived and/or modified sequence opt2 from anti-HIV_CAP256-VRC26.10_LightChain
  source 1..333: mol_type = other RNA
cagtccgtcctcacccagcccccctccgtctccgccgcccccggccagaaggtcaccatctcctgctccggctcctcctccaacatcggcgacaactacgtctcctggtaccagcacctccccggcaccgcccccaagctcctcatctacgagaacacccgccgcccctccggcatccccgaccgcttctccggctccaagtccggcacctccgccaccctcgccatcaccggcctccagaccggcgacgaggccgactactactgcggcacctgggacgtccgccccaaccgcggcgccgtcttcggcaccggcaccaaggtcaccgtcctc

SEQ ID NO: 16477 - RNA, 432 nt, synthetic construct
  misc_feature 1..432: note = derived and/or modified sequence opt2 from anti-HIV_CAP256-VRC26.10_HeavyChain
  source 1..432: mol_type = other RNA
caggccatcctcgtcgagtccggcggcggcgtcgtccagcccggccgctccctccgcctctcctgcgccgcctcccagttcaccttctccggccacggcctccactgggtccgccaggcccccggcaagggcctcgagtgggtcgcctccatctccttcgccggcaccaagatggactacgccgactccgtcaagggccgcttcgccatctcccgcgacaactccaagaacaccctctacctccagatgaactccctccgcgtcgaggacaccgccctctactactgcgccaaggacatgcgcgagtacgagtgcgagtactggacctccgactactacgacttcggccgcccccagccctgcatcgaccgccgcggcgtcgtcggcatcttcgacatgtggggccagggcaccatggtcaccgtctccacc

SEQ ID NO: 16478 - RNA, 321 nt, synthetic construct
  misc_feature 1..321: note = derived and/or modified sequence opt2 from anti-HIV_CAP256-VRC26.11_LightChain
  source 1..321: mol_type = other RNA
cagtccgtcctcacccagcccccctccgtctccgccgcccccggccagaacgtcaccatctcctgctccggccccccctcccacatcgagaagaacgacgtctcctggtaccagcgcctccccggcatggcccccaagatggtcatctacgagtccaagcgccgccccctcggcatccccgtccgcttctccgcctcccgctccggctcctccgccaccctcgtcatcaccggcctccagaccgccgacgaggccgactactactgcggcacctgggacggccgcatgaacttcggcaccggcaccaccgtctccgtcctc

SEQ ID NO: 16479 - RNA, 429 nt, synthetic construct
  misc_feature 1..429: note = derived and/or modified sequence opt2 from anti-HIV_CAP256-VRC26.11_HeavyChain
  source 1..429: mol_type = other RNA
gaggtccagctcgtcgagtccggcggcggcgtcgtcccccccggcaagtccctcaccctctcctgcgtcgcctcccgcttcaccttctccgccttcggcatgcactgggtccgccaggcccccggcaagggcctcgagtgggtcgcctccatctccttcgccggcatcaagaagtactacgccgactccgtcaagggccgcttctccatctcccgcgacaactccaacaccctcttcctccagatgaacggcctccgcggcgaggacaccggcctctaccactgcgtcaaggacatgcgcgagctcgagtgcgaggagtgggcctccgactactacgacttcggcaagccccagccctgcctcgaccgccgcggcgtctccggcatctccgcctggtggggccccggcaccatggtcaccgtctcctcc

SEQ ID NO: 16480 - RNA, 321 nt, synthetic construct
  misc_feature 1..321: note = derived and/or modified sequence opt2 from anti-HIV_CAP256-VRC26.12_LightChain
  source 1..321: mol_type = other RNA
cagtccgtcctcacccagcccccctccgtctccaccgcccccggccagaccgtcaccgtctcctgctccggcggcacctccaacaccggcaacaacttcgtctcctggtaccagcacctccccggcaccgcccccaagctcctcatctacgagaacaacaagcgccccctcggcgtccccgaccgcttctccggcgccaagtccggcacctccgccaccctcgccatcaccggcctccagaccggcgacgagggcgactactactgcgccacctggtccggctccctcaacatcggcaccggcaccaaggtctccgtcctc

SEQ ID NO: 16481 - RNA, 432 nt, synthetic construct
  misc_feature 1..432: note = derived and/or modified sequence opt2 from anti-HIV_CAP256-VRC26.12_HeavyChain
  source 1..432: mol_type = other RNA
gaggtccagctcgtccagtccggcggcggcgtcgtccagcccggccgctccctccgcctctcctgcgccgccccctacttcgagttcggccgctacggcttccactgggtccgccaggcccccggcaagggcctcgagtgggtcgcctccatctccttcgccggccgcgactactaccactccccctccgtctggggccgcttcaccatctcccgcgacaactccaagaacaccctctacctccagatgaactccctccgcatcgaggacaccgccctctacttctgcgcccgcgacctccgcgagtccgagtgcgaggagtgggagtccgactactacgacttcggcaagaagggcccctgcgtcaagccccgcggcgtcgccggcggcctcgacctctggggccagggcaccatggtcatcgtctcctcc

SEQ ID NO: 16482 - RNA, 333 nt, synthetic construct
  misc_feature 1..333: note = derived and/or modified sequence opt2 from anti-HIV_CAP256-VRC26.I1_LightChain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16483 - RNA, 432 nt, synthetic construct
  misc_feature 1..432: note = derived and/or modified sequence opt2 from anti-HIV_CAP256-VRC26.I1_HeavyChain
  source 1..432: mol_type = other RNA
caggtccagctcgtcgagtccggcggcggcgtcgtccagcccggccgctccctccgcctctcctgcgccgcctccggcttcaccttctccaactacgccatggactgggtccgccaggcccccggcaagggcctcgagtgggtcgccgtcatctcctccgacggctccaacaagaactacgccgactccgtcaagggccgcttcaccatctcccgcgacaactccaagaacaccctctacctccagatgaactccctccgcgccgaggacaccgccgtctactactgcgccaaggacctcggcgagaacaagaacgacgagtgggccaccgactactacgacctctccatcgcctaccccgtccaggacccccgcgccgtcgtcggcgccttcgacatctggggccagggcaccatggtcaccgtctcctcc

SEQ ID NO: 16484 - RNA, 333 nt, synthetic construct
  misc_feature 1..333: note = derived and/or modified sequence opt2 from anti-HIV_CAP256-VRC26.I2_LightChain
  source 1..333: mol_type = other RNA
cagtccgtcctcacccagcccccctccgtctccgccgcccccggccagaaggtcaccatctcctgctccggctcctcctccaccatcggcaacaactacgtctcctggtaccagctcctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16485 - RNA, 432 nt, synthetic construct
  misc_feature 1..432: note = derived and/or modified sequence opt2 from anti-HIV_CAP256-VRC26.I2_HeavyChain
  source 1..432: mol_type = other RNA
caggtccagctcgtcgagtccggcggcggcgtcgtccagcccggccgctccctccgcctctcctgcgccgcctccggcttcaccttctccaacttcgccatgggctgggtccgccaggcccccggcaagggcctcgagtgggtcgccttcatctcctccgacggctccaacaagaactacggcgactccgtcaagggccgcttcaccatctcccgcgacaactccaagaacaccctcttcctccagatgaactccctccgcgccgaggacaccgccctctactactgcgccaaggacgtcggcgagtacaagtccgacgagtgggccaccgactactacgacctctccatcgcctaccccatccaggacccccgcgccatggtcggcgccttcgacatctggggccagggcaccatggtcaccgtctcctcc

SEQ ID NO: 16486 - RNA, 333 nt, synthetic construct
  misc_feature 1..333: note = derived and/or modified sequence opt2 from anti-HIV_CAP256-VRC26.UCA_LightChain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16487 - RNA, 432 nt, synthetic construct
  misc_feature 1..432: note = derived and/or modified sequence opt2 from anti-HIV_CAP256-VRC26.UCA_HeavyChain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccatcggctaccccggccaggacccccgcggcgtcgtcggcgccttcgacatctggggccagggcaccatggtcaccgtctcctcc

SEQ ID NO: 16488 - RNA, 324 nt, synthetic construct
  misc_feature 1..324: note = derived and/or modified sequence opt2 from anti-HIV_CH01_LightChain
  source 1..324: mol_type = other RNA
gagatcgtcctcgcccagtcccccggcaccctctccctctcccccggcgagcgcgccaccctctcctgccgcgcctcccacaacgtccaccccaagtacttcgcctggtaccagcagaagcccggccagtccccccgcctcctcatctacggcggctccacccgcgccgccggcatccccggcaagttctccggctccggctccggcaccgacttcaccctcaccatctcccgcgtcgaccccgaggacttcgccgtctactactgccagcagtacggcggctccccctacaccttcggccagggcaccaaggtcgagatcaag

SEQ ID NO: 16489 - RNA, 399 nt, synthetic construct
  misc_feature 1..399: note = derived and/or modified sequence opt2 from anti-HIV_CH01_HeavyChain
  source 1..399: mol_type = other RNA
gaggtccagctcgtcgagtccggcgccaacgtcgtccgccccggcggctccctccgcctctcctgcaaggcctccggcttcatcttcgagaacttcggcttctcctgggtccgccaggcccccggcaagggcctccagtgggtcgccggcctcaactggaacggcggcgacacccgctacgccgactccgtcaagggccgcttccgcatgtcccgcgacaactcccgcaacttcgtctacctcgacatggacaaggtcggcgtcgacgacaccgccttctactactgcgcccgcggcaccgactacaccatcgacgacgccggcatccactaccagggctccggcaccttctggtacttcgacctctggggccgcggcaccctcgtctccgtctcctcc

SEQ ID NO: 16490 - RNA, 324 nt, synthetic construct
  misc_feature 1..324: note = derived and/or modified sequence opt2 from anti-HIV_CH02_LightChain
  source 1..324: mol_type = other RNA
gagatcgtcctcacccagtcccccgccaccctctccgtctcccccggcgagcgcgccaccctctcctgccgcgcctcccagaacgtccacccccgctacttcgcctggtaccagcagaagcgcggccagtccccccgcctcctcatccactccggctccacccgcgccgccggcatcgccgaccgcttctccggcggcggctccggcatgcacttcaccctcaccatcacccgcgtcgagcccgaggacttcgccgtctacttctgccagcagtacggcggctccccctacaccttcggccagggcacccgcgtcgagctccgc

SEQ ID NO: 16491 - RNA, 399 nt, synthetic construct
  misc_feature 1..399: note = derived and/or modified sequence opt2 from anti-HIV_CH02_HeavyChain
  source 1..399: mol_type = other RNA
gaggtccagctcgtcgagtccggcggctccgtcgtccgccccggcggctccctccgcctctcctgccgcgcctccggcttcatcttcgagaactacggcctcacctgggtccgccaggtccccggcaagggcctccactgggtctccggcatgaactggaacggcggcgacacccgctacgccgactccgtccgcggccgcttctccatgtcccgcgacaactccaacaacatcgcctacctccagatgaacaacctccgcgtcgaggacaccgccctctactactgcgcccgcggcaccgactacaccatcgacgaccagggccgcttctaccagggctccggcaccttctggtacttcgacttctggggccgcggcaccctcgtcaccgtctcctcc

SEQ ID NO: 16492 - RNA, 324 nt, synthetic construct
  misc_feature 1..324: note = derived and/or modified sequence opt2 from anti-HIV_CH03_LightChain
  source 1..324: mol_type = other RNA
gagatcgtcctcacccagtcccccgccaccctctccctctcccccggcgagcgcgccaccctctcctgccgcgcctcccagtccgtccaccccaagtacttcgcctggtaccagcagaagcccggccagtccccccgcctcctcatctactccggctccacccgcgccgccggcatcgccgaccgcttctccggcggcggctccggcatccacttcaccctcaccatcacccgcgtcgagcccgaggacttcgccgtctacttctgccagcagtacggcggctccccctacaccttcggccagggcaccaaggtcgagctccgc

SEQ ID NO: 16493 - RNA, 399 nt, synthetic construct
  misc_feature 1..399: note = derived and/or modified sequence opt2 from anti-HIV_CH03_HeavyChain
  source 1..399: mol_type = other RNA
gaggtccagctcgtcgagtccggcggcggcgtcgtccgccccggcggctccctccgcctctcctgcgccgcctccggcttcatcttcgagaactacggcctcacctgggtccgccaggtccccggcaagggcctccactgggtctccggcatgaactggaacggcggcgacacccgctacgccgactccgtccgcggccgcttctccatgtcccgcgacaactccaacaacatcgcctacctccagatgaagaacctccgcgtcgacgacaccgccctctactactgcgcccgcggcaccgactacaccatcgacgaccagggcatcttctacaagggctccggcaccttctggtacttcgacctctggggccgcggcaccctcgtcaccgtctcctcc

SEQ ID NO: 16494 - RNA, 324 nt, synthetic construct
  misc_feature 1..324: note = derived and/or modified sequence opt2 from anti-HIV_CH04_LightChain
  source 1..324: mol_type = other RNA
gagatcgtcctcacccagtcccccgacaccctctccctctcccccggcgagcgcgccaccctctcctgccgcgcctcccagtccgtccactcccgctacttcgcctggtaccagcacaagcccggccagcccccccgcctcctcatctacggcggctccacccgcgccaccggcatccccaaccgcttctccgccggcggctccggcacccagttcaccctcaccgtcaaccgcctcgaggccgaggacttcgccgtctactactgccagcagtacggccgctccccctacaccttcggccagggcaccaaggtcgagatccgc

SEQ ID NO: 16495 - RNA, 399 nt, synthetic construct
  misc_feature 1..399: note = derived and/or modified sequence opt2 from anti-HIV_CH04_HeavyChain
  source 1..399: mol_type = other RNA
gaggtccagctcgtcgagtccggcggcggcctcatccgccccggcggctccctccgcctctcctgcaagggctccggcttcatcttcgagaacttcggcttcggctgggtccgccagggccccggcaagggcctcgagtgggtctccggcaccaactggaacggcggcgactcccgctacggcgactccgtcaagggccgcttcaccatctcccgcgacaactccaacaacttcgtctacctccagatgaactccctccgccccgaggacaccgccatctactactgcgcccgcggcaccgactacaccatcgacgaccagggcatccgctaccagggctccggcaccttctggtacttcgacgtctggggccgcggcaccctcgtcaccgtctcctcc

SEQ ID NO: 16496 - RNA, 627 nt, synthetic construct
  misc_feature 1..627: note = derived and/or modified sequence opt2 from anti-HIV_CH103_LightChain
  source 1..627: mol_type = other RNA
tacgagctcacccagcccccctccgtctccgtctcccccggccagaccgccaccatcacctgctccggcgcctccaccaacgtctgctggtaccaggtcaagcccggccagtcccccgaggtcgtcatcttcgagaactacaagcgcccctccggcatccccgaccgcttctccggctccaagtccggctccaccgccaccctcaccatccgcggcacccaggccatcgacgaggccgactactactgccaggtctgggactccttctccaccttcgtcttcggctccggcacccaggtcaccgtcctccgccagcccaaggccaaccccaccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16497 - RNA, 678 nt, synthetic construct
  misc_feature 1..678: note = derived and/or modified sequence opt2 from anti-HIV_CH103_HeavyChain
  source 1..678: mol_type = other RNA
caggtccagctccaggagtccggccccggcgtcgtcaagtcctccgagaccctctccctcacctgcaccgtctccggcggctccatgggcggcacctactggtcctggctccgcctctcccccggcaagggcctcgagtggatcggctacatcttccacaccggcgagaccaactactccccctccctcaagggccgcgtctccatctccgtcgacacctccgaggaccagttctccctccgcctccgctccgtcaccgccgccgacaccgccgtctacttctgcgcctccctcccccgcggccagctcgtcaacgcctacttccgcaactggggccgcggctccctcgtctccgtcaccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaag

SEQ ID NO: 16498 - RNA, 321 nt, synthetic construct
  misc_feature 1..321: note = derived and/or modified sequence opt2 from anti-HIV_M66.6_LightChain
  source 1..321: mol_type = other RNA
gacatccagctcacccagtccccctcctccctctccgcctccgtcggcgaccgcgtcaccatcacctgccgcgcctcccagtccatcggctcctacctcaactggtaccagcagaagcccggcaaggcccccaagctcctcatctacgccgcctccaccctccagtccggcgtcccctcccgcttctccggctccggctccggcaccgacttcaccctcaccatctcctccctccagcccgaggactccgccacctactactgccagcagtcctactccacccccttcaccttcggccccggcaccaaggtcgacatccgc

SEQ ID NO: 16499 - RNA, 390 nt, synthetic construct
  misc_feature 1..390: note = derived and/or modified sequence opt2 from anti-HIV_M66.6_HeavyChain
  source 1..390: mol_type = other RNA
caggtccagctcgtccagtccggcgccgaggtcaagaagcccggcgagtccctcaagatctcctgcaaggtctccggctacaacttcgcctccgagtggatcggctgggtccgccagatgcccggcaagggcctcgagtggatgggcatcatctaccccggcgactccgacaccaagtactccccctccttccagggccaggtcatcatctccgccgacaagtccatcaacaccgcctacctccagtggtcctccctcaaggcctccgacaccgccatctactactgcgcccgccagaaccactacggctccggctcctacttctaccgcaccgcctactactacgccatggacgtctggggccagggcaccaccgtcaccgtctcctcc

SEQ ID NO: 16500 - RNA, 327 nt, synthetic construct
  misc_feature 1..327: note = derived and/or modified sequence opt2 from anti-HIV_NIH45-46_LightChain
  source 1..327: mol_type = other RNA
gagatcgtcctcacccagtcccccgccaccctctccctctcccccggcgagaccgccatcatctcctgccgcacctcccagtccggctccctcgcctggtaccagcagcgccccggccaggccccccgcctcgtcatctactccggctccacccgcgccgccggcatccccgaccgcttctccggctcccgctggggcgccgactacaacctctccatctccaacctcgagtccggcgacttcggcgtctactactgccagcagtacgagttcttcggccagggcaccaaggtccaggtcgacatcaagcgcaccgtcgccgccccc

SEQ ID NO: 16501 - RNA, 399 nt, synthetic construct
  misc_feature 1..399: note = derived and/or modified sequence opt2 from anti-HIV_NIH45-46_HeavyChain
  source 1..399: mol_type = other RNA
caggtccgcctctcccagtccggcggccagatgaagaagcccggcgagtccatgcgcctctcctgccgcgcctccggctacgagttcctcaactgccccatcaactggatccgcctcgcccccggccgccgccccgagtggatgggctggctcaagccccgcggcggcgccgtcaactacgcccgcaagttccagggccgcgtcaccatgacccgcgacgtctactccgacaccgccttcctcgagctccgctccctcacctccgacgacaccgccgtctacttctgcacccgcggcaagtactgcaccgcccgcgactactacaactgggacttcgagcactggggccgcggcgcccccgtcaccgtctcctccgcctccaccaagggcccctccgtc

SEQ ID NO: 16502 - RNA, 330 nt, synthetic construct
  misc_feature 1..330: note = derived and/or modified sequence opt2 from anti-HIV_PG16_LightChain
  source 1..330: mol_type = other RNA
cagtccgccctcacccagcccgcctccgtctccggctcccccggccagaccatcaccatctcctgcaacggcacctcctccgacgtcggcggcttcgactccgtctcctggtaccagcagtcccccggcaaggcccccaaggtcatggtcttcgacgtctcccaccgcccctccggcatctccaaccgcttctccggctccaagtccggcaacaccgcctccctcaccatctccggcctccacatcgaggacgagggcgactacttctgctcctccctcaccgaccgctcccaccgcatcttcggcggcggcaccaaggtcaccgtcctc

SEQ ID NO: 16503 - RNA, 411 nt, synthetic construct
  misc_feature 1..411: note = derived and/or modified sequence opt2 from anti-HIV_PG16_HeavyChain
  source 1..411: mol_type = other RNA
caggagcagctcgtcgagtccggcggcggcgtcgtccagcccggcggctccctccgcctctcctgcctcgcctccggcttcaccttccacaagtacggcatgcactgggtccgccaggcccccggcaagggcctcgagtgggtcgccctcatctccgacgacggcatgcgcaagtaccactccgactccatgtggggccgcgtcaccatctcccgcgacaactccaagaacaccctctacctccagttctcctccctcaaggtcgaggacaccgccatgttcttctgcgcccgcgaggccggcggccccatctggcacgacgacgtcaagtactacgacttcaacgacggctactacaactaccactacatggacgtctggggcaagggcaccaccgtcaccgtctcctcc

SEQ ID NO: 16504 - RNA, 315 nt, synthetic construct
  misc_feature 1..315: note = derived and/or modified sequence opt2 from anti-HIV_PGT122_LightChain
  source 1..315: mol_type = other RNA
accttcgtctccgtcgcccccggccagaccgcccgcatcacctgcggcgaggagtccctcggctcccgctccgtcatctggtaccagcagcgccccggccaggccccctccctcatcatctacaacaacaacgaccgcccctccggcatccccgaccgcttctccggctcccccggctccaccttcggcaccaccgccaccctcaccatcacctccgtcgaggccggcgacgaggccgactactactgccacatctgggactcccgccgccccaccaactgggtcttcggcgagggcaccaccctcatcgtcctc

SEQ ID NO: 16505 - RNA, 396 nt, synthetic construct
  misc_feature 1..396: note = derived and/or modified sequence opt2 from anti-HIV_PGT122_HeavyChain
  source 1..396: mol_type = other RNA
caggtccacctccaggagtccggccccggcctcgtcaagccctccgagaccctctccctcacctgcaacgtctccggcaccctcgtccgcgacaactactggtcctggatccgccagcccctcggcaagcagcccgagtggatcggctacgtccacgactccggcgacaccaactacaacccctccctcaagtcccgcgtccacctctccctcgacaagtccaagaacctcgtctccctccgcctcaccggcgtcaccgccgccgactccgccatctactactgcgccaccaccaagcacggccgccgcatctacggcgtcgtcgccttcaaggagtggttcacctacttctacatggacgtctggggcaagggcacctccgtcaccgtctcctcc

SEQ ID NO: 16506 - RNA, 315 nt, synthetic construct
  misc_feature 1..315: note = derived and/or modified sequence opt2 from anti-HIV_PGT123_LightChain
  source 1..315: mol_type = other RNA
tcctccatgtccgtctcccccggcgagaccgccaagatctcctgcggcaaggagtccatcggctcccgcgccgtccagtggtaccagcagaagcccggccagcccccctccctcatcatctacaacaaccaggaccgccccgccggcgtccccgagcgcttctccgcctcccccgacttccgccccggcaccaccgccaccctcaccatcaccaacgtcgacgccgaggacgaggccgactactactgccacatctacgacgcccgcggcggcaccaactgggtcttcgaccgcggcaccaccctcaccgtcctc

SEQ ID NO: 16507 - RNA, 396 nt, synthetic construct
  misc_feature 1..396: note = derived and/or modified sequence opt2 from anti-HIV_PGT123_HeavyChain
  source 1..396: mol_type = other RNA
cagctccacctccaggagtccggccccggcctcgtcaagccccccgagaccctctccctcacctgctccgtctccggcgcctccatcaacgacgcctactggtcctggatccgccagtcccccggcaagcgccccgagtgggtcggctacgtccaccactccggcgacaccaactacaacccctccctcaagcgccgcgtcaccttctccctcgacaccgccaagaacgaggtctccctcaagctcgtcgacctcaccgccgccgactccgccacctacttctgcgcccgcgccctccacggcaagcgcatctacggcatcgtcgccctcggcgagctcttcacctacttctacatggacgtctggggcaagggcaccgccgtcaccgtctcctcc

SEQ ID NO: 16508 - RNA, 315 nt, synthetic construct
  misc_feature 1..315: note = derived and/or modified sequence opt2 from anti-HIV_PGT125_LightChain
  source 1..315: mol_type = other RNA
cagtccgccctcacccagcccccctccgcctccggctcccccggccagtccatcaccatctcctgcaacggcaccgccaccaacttcgtctcctggtaccagcagttccccgacaaggcccccaagctcatcatcttcggcgtcgacaagcgcccccccggcgtccccgaccgcttctccggctcccgctccggcaccaccgcctccctcaccgtctcccgcctccagaccgacgacgaggccgtctactactgcggctccctcgtcggcaactgggacgtcatcttcggcggcggcaccaccctcaccgtcctc

SEQ ID NO: 16509 - RNA, 411 nt, synthetic construct
  misc_feature 1..411: note = derived and/or modified sequence opt2 from anti-HIV_PGT125_HeavyChain
  source 1..411: mol_type = other RNA
cagtcccagctccaggagtccggcccccgcctcgtcgaggcctccgagaccctctccctcacctgcaacgtctccggcgagtccaccggcgcctgcacctacttctggggctgggtccgccaggcccccggcaagggcctcgagtggatcggctccctctcccactgccagtccttctggggctccggctggaccttccacaacccctccctcaagtcccgcctcaccatctccctcgacacccccaagaaccaggtcttcctcaagctcacctccctcaccgccgccgacaccgccacctactactgcgcccgcttcgacggcgaggtcctcgtctacaaccactggcccaagcccgcctgggtcgacctctggggccgcggcatccccgtcaccgtcaccgtctcctcc

SEQ ID NO: 16510 - RNA, 315 nt, synthetic construct
  misc_feature 1..315: note = derived and/or modified sequence opt2 from anti-HIV_PGT126_LightChain
  source 1..315: mol_type = other RNA
cagtccgccctcacccagcccccctccgcctccggctcccccggccagtccatctccatctcctgcaccggcacctccaaccgcttcgtctcctggtaccagcagcaccccggcaaggcccccaagctcgtcatctacggcgtcaacaagcgcccctccggcgtccccgaccgcttctccggctccaagtccggcaacaccgcctccctcaccgtctccggcctccagaccgacgacgaggccgtctactactgctcctccctcgtcggcaactgggacgtcatcttcggcggcggcaccaagctcaccgtcctc

SEQ ID NO: 16511 - RNA, 411 nt, synthetic construct
  misc_feature 1..411: note = derived and/or modified sequence opt2 from anti-HIV_PGT126_HeavyChain
  source 1..411: mol_type = other RNA
cagccccagctccaggagtccggccccggcctcgtcgaggcctccgagaccctctccctcacctgcaccgtctccggcgactccaccgccgcctgcgactacttctggggctgggtccgccagccccccggcaagggcctcgagtggatcggcggcctctcccactgcgccggctactacaacaccggctggacctaccacaacccctccctcaagtcccgcctcaccatctccctcgacacccccaagaaccaggtcttcctcaagctcaactccgtcaccgccgccgacaccgccatctactactgcgcccgcttcgacggcgaggtcctcgtctaccacgactggcccaagcccgcctgggtcgacctctggggccgcggcaccctcgtcaccgtcaccgtctcctcc

SEQ ID NO: 16512 - RNA, 315 nt, synthetic construct
  misc_feature 1..315: note = derived and/or modified sequence opt2 from anti-HIV_PGT127_LightChain
  source 1..315: mol_type = other RNA
cagtccgccctcacccagcccccctccgcctccggctcccccggccagtccatcaccatctcctgcaccggcacctccaacaacttcgtctcctggtaccagcagtaccccggcaaggcccccaagctcgtcatctacgaggtcaacaagcgcccctccggcgtccccgaccgcttctccggctccaagtccggctccaccgcctccctcaccgtctccggcctccaggccgacgacgagggcgtctactactgctcctccctcgtcggcaactgggacgtcatcttcggcggcggcaccaagctcaccgtcctc

SEQ ID NO: 16513 - RNA, 405 nt, synthetic construct
  misc_feature 1..405: note = derived and/or modified sequence opt2 from anti-HIV_PGT127_HeavyChain
  source 1..405: mol_type = other RNA
cagccccagctccaggagtccggccccggcctcgtcgaggcctccgagaccctctccctcacctgcaccgtctccggcgactccaccggccgctgcaactacttctggggctgggtccgccagccccccggcaagggcctcgagtggatcggctccctctcccactgccgctcctactacaacaccgactggacctaccacaacccctccctcaagtcccgcctcaccatctccctcgacacccccaagaaccaggtcttcctccgcctcacctccgtcaccgccgccgacaccgccacctactactgcgcccgcttcggcggcgaggtcctcgtctaccgcgactggcccaagcccgcctgggtcgacctctggggccgcggcaccctcgtcaccgtctcctcc

SEQ ID NO: 16514 - RNA, 315 nt, synthetic construct
  misc_feature 1..315: note = derived and/or modified sequence opt2 from anti-HIV_PGT128_LightChain
  source 1..315: mol_type = other RNA
cagtccgccctcacccagcccccctccgcctccggctcccccggccagtccatcaccatctcctgcaccggcacctccaacaacttcgtctcctggtaccagcagcacgccggcaaggcccccaagctcgtcatctacgacgtcaacaagcgcccctccggcgtccccgaccgcttctccggctccaagtccggcaacaccgcctccctcaccgtctccggcctccagaccgacgacgaggccgtctactactgcggctccctcgtcggcaactgggacgtcatcttcggcggcggcaccaagctcaccgtcctc

SEQ ID NO: 16515 - RNA, 405 nt, synthetic construct
  misc_feature 1..405: note = derived and/or modified sequence opt2 from anti-HIV_PGT128_HeavyChain
  source 1..405: mol_type = other RNA
cagccccagctccaggagtccggccccaccctcgtcgaggcctccgagaccctctccctcacctgcgccgtctccggcgactccaccgccgcctgcaactccttctggggctgggtccgccagccccccggcaagggcctcgagtgggtcggctccctctcccactgcgcctcctactggaaccgcggctggacctaccacaacccctccctcaagtcccgcctcaccctcgccctcgacacccccaagaacctcgtcttcctcaagctcaactccgtcaccgccgccgacaccgccacctactactgcgcccgcttcggcggcgaggtcctccgctacaccgactggcccaagcccgcctgggtcgacctctggggccgcggcaccctcgtcaccgtctcctcc

SEQ ID NO: 16516 - RNA, 330 nt, synthetic construct
  misc_feature 1..330: note = derived and/or modified sequence opt2 from anti-HIV_PGT130_LightChain
  source 1..330: mol_type = other RNA
cagtccgccctcacccagcccccctccgcctccggctccctcggccagtccgtcaccatctcctgcaacggcacctcctccgacatcggcggctggaacttcgtctcctggtaccagcagttccccggccgcgccccccgcctcatcatcttcgaggtcaacaagcgcccctccggcgtccccggccgcttctccggctccaagtccggcaactccgcctccctcaccgtctccggcctccagtccgacgacgagggccagtacttctgctcctccctcttcggccgctgggacgtcgtcttcggcggcggcaccaagctcaccgtcctc

SEQ ID NO: 16517 - RNA, 387 nt, synthetic construct
  misc_feature 1..387: note = derived and/or modified sequence opt2 from anti-HIV_PGT130_HeavyChain
  source 1..387: mol_type = other RNA
caggtccagctccaggagtccggccccggcctcgtcaagcccgccgagaccctctccctcacctgctccgtctccggcgagtccatcaacaccggccactactactggggctgggtccgccaggtccccggcaagggcctcgagtggatcggccacatccactacaccaccgccgtcctccacaacccctccctcaagtcccgcctcaccatcaagatctacaccctccgcaaccagatcaccctccgcctctccaacgtcaccgccgccgacaccgccgtctaccactgcgtccgctccggcggcgacatcctctactactacgagtggcagaagccccactggttctccccctggggccccggcatccacgtcaccgtctcctcc

SEQ ID NO: 16518 - RNA, 330 nt, synthetic construct
  misc_feature 1..330: note = derived and/or modified sequence opt2 from anti-HIV_PGT131_LightChain
  source 1..330: mol_type = other RNA
cagtccgccctcacccagcccccctccgcctccggctccctcggccagtccctcaccatctcctgctccggcaccggctccgacatcggctcctggaacttcgtctcctggtaccagcagttccccggccgcgcccccaacctcatcatcttcgaggtcaaccgccgccgctccggcgtccccgaccgcttctccggctccaagtccggcaacaccgcctccctcaccgtctccggcctccgctccgaggacgaggccgagtacttctgctcctccctctccggccgctgggacatcgtcttcggcggcggcaccaaggtcaccgtcctc

SEQ ID NO: 16519 - RNA, 387 nt, synthetic construct
  misc_feature 1..387: note = derived and/or modified sequence opt2 from anti-HIV_PGT131_HeavyChain
  source 1..387: mol_type = other RNA
caggtccagctccaggagtccggccccggcctcgtcaagccctccgagaccctctccctcacctgcaccgtctccggcgactccatcaacaccggccaccactactggggctgggtccgccaggtccccggcaagggccccgagtggatcgcccacatccactacaacaccgccgtcctccacaaccccgccctcaagtcccgcgtcaccatctccatcttcaccctcaagaacctcatcaccctctccctctccaacgtcaccgccgccgacaccgccgtctacttctgcgtccgctccggcggcgacatcctctactacatcgagtggcagaagccccactggttctacccctggggccccggcatcctcgtcaccgtctcctcc

SEQ ID NO: 16520 - RNA, 321 nt, synthetic construct
  misc_feature 1..321: note = derived and/or modified sequence opt2 from anti-HIV_PGT135_LightChain
  source 1..321: mol_type = other RNA
gagatcgtcatgacccagtcccccgacaccctctccgtctcccccggcgagaccgtcaccctctcctgccgcgcctcccagaacatcaacaagaacctcgcctggtaccagtacaagcccggccagtccccccgcctcgtcatcttcgagacctactccaagatcgccgccttccccgcccgcttcgtcgcctccggctccggcaccgagttcaccctcaccatcaacaacatgcagtccgaggacgtcgccgtctactactgccagcagtacgaggagtggccccgcaccttcggccagggcaccaaggtcgacatcaag

SEQ ID NO: 16521 - RNA, 399 nt, synthetic construct
  misc_feature 1..399: note = derived and/or modified sequence opt2 from anti-HIV_PGT135_HeavyChain
  source 1..399: mol_type = other RNA
cagctccagatgcaggagtccggccccggcctcgtcaagccctccgagaccctctccctctcctgcaccgtctccggcgactccatccgcggcggcgagtggggcgacaaggactaccactggggctgggtccgccactccgccggcaagggcctcgagtggatcggctccatccactggcgcggcaccacccactacaaggagtccctccgccgccgcgtctccatgtccatcgacacctcccgcaactggttctccctccgcctcgcctccgtcaccgccgccgacaccgccgtctacttctgcgcccgccaccgccaccacgacgtcttcatgctcgtccccatcgccggctggttcgacgtctggggccccggcgtccaggtcaccgtctcctcc

SEQ ID NO: 16522 - RNA, 321 nt, synthetic construct
  misc_feature 1..321: note = derived and/or modified sequence opt2 from anti-HIV_PGT136_LightChain
  source 1..321: mol_type = other RNA
gagatcgtcatgacccagtccccccccaccctctccgtctcccccggcgagaccgccaccctctcctgccgcgcctcccagaacgtcaagaacaacctcgcctggtaccagctcaagcccggccaggccccccgcctcctcatcttcgacgcctcctcccgcgccggcggcatccccgaccgcttctccggctccggctacggcaccgacttcaccctcaccgtcaactccgtccagtccgaggacttcggcgactacttctgccagcagtacgaggagtggccccgcaccttcggccagggcaccaaggtcgacatcaag

SEQ ID NO: 16523 - RNA, 402 nt, synthetic construct
  misc_feature 1..402: note = derived and/or modified sequence opt2 from anti-HIV_PGT136_HeavyChain
  source 1..402: mol_type = other RNA
cagctccagctccaggagtccggccccggcctcgtcaagccctccgagaccctctccctcacctgcaccgtctccggcggctccatgcgcggcaccgactggggcgagaacgacttccactacggctggatccgccagtcctccgccaagggcctcgagtggatcggctccatccactggcgcggccgcaccacccactacaagacctccttccgctcccgcgccaccctctccatcgacacctccaacaaccgcttctccctcaccttctccttcgtcaccgccgccgacaccgccgtctactactgcgcccgccacaagtaccacgacatcttccgcgtcgtccccgtcgccggctggttcgacccctggggccagggcctcctcgtcaccgtctcctcc

SEQ ID NO: 16524 - RNA, 321 nt, synthetic construct
  misc_feature 1..321: note = derived and/or modified sequence opt2 from anti-HIV_PGT137_LightChain
  source 1..321: mol_type = other RNA
gagatcatgatgacccagtcccccgccatcctctccgtctcccccggcgaccgcgccaccctctcctgccgcgcctcccagtccgtcaagaacaacctcgcctggtaccagaagcgccccggccaggccccccgcctcctcatcttcgacacctcctcccgcgcctccggcatccccgcccgcttctccggcggcggctccggcaccgagttcaccctcaccgtcaactccatgcagtccgaggacttcgccacctactactgccagcagtacgaggagtggccccgcaccttcggccagggcaccaaggtcgagatcaag

SEQ ID NO: 16525 - RNA, 399 nt, synthetic construct
  misc_feature 1..399: note = derived and/or modified sequence opt2 from anti-HIV_PGT137_HeavyChain
  source 1..399: mol_type = other RNA
gaggtccacctcgaggagtccggccccggcctcgtccgcccctccgagaccctctccctcacctgcaccgcctccggcggctccatccgcggcggcgagtggggcgactccgactaccactggggctgggtccgccactcccccgagaagggcctcgagtggatcggctccatccactggcgcggcaccacccactacaacgcccccttccgcggccgcggccgcctctccatcgacctctcccgcaaccagttctccctccgcctcacctccgtcaccgccgaggacaccgccgtctactactgcgtcaagcacaagtaccacgacatcgtcatggtcgtccccatcgccggctggttcgacccctggggccagggcctccaggtcaccgtctcctcc

SEQ ID NO: 16526 - RNA, 336 nt, synthetic construct
  misc_feature 1..336: note = derived and/or modified sequence opt2 from anti-HIV_PGT141_LightChain
  source 1..336: mol_type = other RNA
gacaccgtcgtcacccagtcccccctctccctccccgtcacccccggcgaggccgcctccatgtcctgctcctccacccagtccctccgccactccaacggcgccaactacctcgcctggtaccagcacaagcccggccagtccccccgcctcctcatccgcctcggctcccagcgcgcctccggcgtccccgaccgcttctccggctccggctccggcacccacttcaccctcaagatctcccgcgtcgaggccgaggacgccgccatctactactgcatgcagggcctcaaccgcccctggaccttcggcaagggcaccaagctcgagatcaag

SEQ ID NO: 16527 - RNA, 423 nt, synthetic construct
  misc_feature 1..423: note = derived and/or modified sequence opt2 from anti-HIV_PGT141_HeavyChain
  source 1..423: mol_type = other RNA
caggtccagctcgtccagtccggccccgaggtcaagaagcccggctcctccgtcaaggtctcctgcaaggcctccggcaacaccttctccaagtacgacgtccactgggtccgccaggccaccggccagggcctcgagtgggtcggctggatgtcccacgagggcgacaagaccgagtccgcccagcgcttcaagggccgcgtcaccttcacccgcgacacctccgcctccaccgcctacatggagctccgcggcctcacctccgacgacaccgccatctactactgcacccgcggctccaagcaccgcctccgcgactacgtcctctacgacgactacggcctcatcaactaccaggagtggaacgactacctcgagttcctcgacgtctggggccacggcaccgccgtcaccgtctcctcc

SEQ ID NO: 16528 - RNA, 336 nt, synthetic construct; identical to SEQ ID NO: 16526
  misc_feature 1..336: note = derived and/or modified sequence opt2 from anti-HIV_PGT142_LightChain
  source 1..336: mol_type = other RNA

SEQ ID NO: 16529 - RNA, 423 nt, synthetic construct
  misc_feature 1..423: note = derived and/or modified sequence opt2 from anti-HIV_PGT142_HeavyChain
  source 1..423: mol_type = other RNA
caggtccagctcgtccagtccggccccgaggtcaagaagcccggctcctccgtcaaggtctcctgcaaggcctccggcaacaccttctccaagtacgacgtccactgggtccgccaggccaccggccagggcctcgagtgggtcggctggatctcccacgagcgcgacaagaccgagtccgcccagcgcttcaagggccgcgtcaccttcacccgcgacacctccgccaccaccgcctacatggagctccgcggcctcacctccgacgacaccgccatctactactgcacccgcggctccaagcaccgcctccgcgactacgtcctctacgacgactacggcctcatcaactaccaggagtggaacgactacctcgagttcctcgacgtctggggccacggcaccgccgtcaccgtctcctcc

SEQ ID NO: 16530 - RNA, 336 nt, synthetic construct
  misc_feature 1..336: note = derived and/or modified sequence opt2 from anti-HIV_PGT143_LightChain
  source 1..336: mol_type = other RNA
gacaccgtcgtcacccagtcccccctctccctccccgtcacccccggcgaggccgcctccatgtcctgcacctccacccagtccctccgccactccaacggcgccaactacctcgcctggtaccagcacaagcccggccagtccccccgcctcctcatccgcctcggctcccagcgcgcctccggcgtccccgaccgcttctccggctccggctccggcacccacttcaccctcaagatctcccgcgtcgagcccgaggacgccgccatctactactgcatgcagggcctcaaccgcccctggaccttcggcaagggcaccaagctcgagatcaag

SEQ ID NO: 16531 - RNA, 423 nt, synthetic construct
  misc_feature 1..423: note = derived and/or modified sequence opt2 from anti-HIV_PGT143_HeavyChain
  source 1..423: mol_type = other RNA
caggtccagctcgagcagtccggcgccgaggtcaagaagcccggctcctccgtcaaggtctcctgcaaggcctccggcaacaccttctccaagtacgacgtccactgggtccgccaggccaccggccagggcctcgagtgggtcggctggatgtcccacgagggcgacaagaccgagtccgcccagcgcttcaagggccgcgtcaccttcacccgcgacacctccgcctccaccgcctacatggagctccgcggcctcacctccgacgacaccgccatctactactgcacccgcggctccaagcaccgcctccgcgactacgtcctctacgacgactacggcctcatcaactaccaggagtggaacgactacctcgagttcctcgacgtctggggccacggcaccgccgtcaccgtctcctcc

SEQ ID NO: 16532 - RNA, 336 nt, synthetic construct
  misc_feature 1..336: note = derived and/or modified sequence opt2 from anti-HIV_PGT144_LightChain
  source 1..336: mol_type = other RNA
gacaccgtcgtcacccagtcccccctctccctctccgtcacccccggcgaggccgcctccatgtcctgcacctccacccagtccctccgccactccaacggcgccaactacctcgcctggtaccagcacaagcccggccagtccccccgcctcctcatccgcctcggctcccagcgcgcctccggcgtccccgaccgcttctccggctccggctccggcacccacttcaccctcaagatctcccgcgtcgaggccgacgacgccgccatctactactgcatgcagggcctcaaccgcccctggaccttcggcaagggcaccaagctcgagatcaag

SEQ ID NO: 16533 - RNA, 423 nt, synthetic construct
  misc_feature 1..423: note = derived and/or modified sequence opt2 from anti-HIV_PGT144_HeavyChain
  source 1..423: mol_type = other RNA
caggtccagctcgtccagtccggcgccgaggtcaagaagcccggctcctccgtcaaggtctcctgcaaggcctccggcaacaccttccgcaagtacgacgtccactgggtccgccaggccaccggccagggcctcgagtgggtcggctggatgtcccacgagggcgacaagaccgagtccgcccagcgcttcaagggccgcgtctccttcacccgcgacaactccgcctccaccgcctacatcgagctccgcggcctcacctccgacgacaccgccatctactactgcaccggcggctccaagcaccgcctccgcgactacgtcctctacgacgactacggcctcatcaaccagcaggagtggaacgactacctcgagttcctcgacgtctggggccacggcaccgccgtcaccgtctcctcc

SEQ ID NO: 16534 - RNA, 336 nt, synthetic construct
  misc_feature 1..336: note = derived and/or modified sequence opt2 from anti-HIV_PGT145_LightChain
  source 1..336: mol_type = other RNA
gaggtcgtcatcacccagtcccccctcttcctccccgtcacccccggcgaggccgcctccctctcctgcaagtgctcccactccctccagcactccaccggcgccaactacctcgcctggtacctccagcgccccggccagaccccccgcctcctcatccacctcgccacccaccgcgcctccggcgtccccgaccgcttctccggctccggctccggcaccgacttcaccctcaagatctcccgcgtcgagtccgacgacgtcggcacctactactgcatgcagggcctccactccccctggaccttcggccagggcaccaaggtcgagatcaag

SEQ ID NO: 16535 - RNA, 420 nt, synthetic construct
  misc_feature 1..420: note = derived and/or modified sequence opt2 from anti-HIV_PGT145_HeavyChain
  source 1..420: mol_type = other RNA
caggtccagctcgtccagtccggcgccgaggtcaagaagcccggctcctccgtcaaggtctcctgcaaggcctccggcaactccttctccaaccacgacgtccactgggtccgccaggccaccggccagggcctcgagtggatgggctggatgtcccacgagggcgacaagaccggcctcgcccagaagttccagggccgcgtcaccatcacccgcgactccggcgcctccaccgtctacatggagctccgcggcctcaccgccgacgacaccgccatctactactgcctcaccggctccaagcaccgcctccgcgactacttcctctacaacgagtacggccccaactacgaggagtggggcgactacctcgccaccctcgacgtctggggccacggcaccgccgtcaccgtctcctcc

SEQ ID NO: 16536 - RNA, 657 nt, synthetic construct
  misc_feature 1..657: note = derived and/or modified sequence opt2 from anti-HIV_PGT151_LightChain
  source 1..657: mol_type = other RNA
gacatcgtcatgacccagacccccctctccctctccgtcacccccggccagcccgcctccatctcctgcaagtcctccgagtccctccgccagtccaacggcaagacctccctctactggtaccgccagaagcccggccagtccccccagctcctcgtcttcgaggtctccaaccgcttctccggcgtctccgaccgcttcgtcggctccggctccggcaccgacttcaccctccgcatctcccgcgtcgaggccgaggacgtcggcttctactactgcatgcagtccaaggacttccccctcaccttcggcggcggcaccaaggtcgacctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16537 - RNA, 720 nt, synthetic construct
  misc_feature 1..720: note = derived and/or modified sequence opt2 from anti-HIV_PGT151_HeavyChain
  source 1..720: mol_type = other RNA
cgcgtccagctcgtcgagtccggcggcggcgtcgtccagcccggcaagtccgtccgcctctcctgcgtcgtctccgacttccccttctccaagtaccccatgtactgggtccgccaggcccccggcaagggcctcgagtgggtcgccgccatctccggcgacgcctggcacgtcgtctactccaactccgtccagggccgcttcctcgtctcccgcgacaacgtcaagaacaccctctacctcgagatgaactccctcaagatcgaggacaccgccgtctaccgctgcgcccgcatgttccaggagtccggccccccccgcctcgaccgctggtccggccgcaactactactactactccggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaag

SEQ ID NO: 16538 - RNA, 657 nt, synthetic construct
  misc_feature 1..657: note = derived and/or modified sequence opt2 from anti-HIV_PGT152_LightChain
  source 1..657: mol_type = other RNA
gacatcgtcatgacccagacccccctctccctctccgtcgaccccggccagcccgcctccatctcctgcaagtcctcccagtccctccgccagtccaacggcaagacctccctctactggtaccagcagaagcccggccagtccccccagctcctcatcttcgaggtctccaaccgcttctccggcgtctccgaccgcttcgtcggctccggctccggcaccgacttcaccctccgcatctcccgcgtcgaggccgaggacgtcggcttctactactgcatgcagtccaaggacttccccctcaccttcggcggcggcaccaaggtcgacctcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16539 - RNA, 720 nt, synthetic construct
  misc_feature 1..720: note = derived and/or modified sequence opt2 from anti-HIV_PGT152_HeavyChain
  source 1..720: mol_type = other RNA
cgcgtccagctcgtcgagtccggcggcggcgtcgtccagcccggcaagtccgtccgcctctcctgcgtcgtctccgacttccccttctccaagtaccccatgtactgggtccgccaggcccccggcaagggcctcgagtgggtcgccgccatctccgccgacgcctggcacgtcgtctactccggctccgtccagggccgcttcctcgtctcccgcgacaactccaagaacatcctctacctcgagatgaacaccctcaagatcgaggacaccgccgtctaccgctgcgcccgcatgttccaggagtccggccccccccgcttcgactcctggtccggccgcaactactactactactccggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaag

SEQ ID NO: 16540 - RNA, 309 nt, synthetic construct
  misc_feature 1..309: note = derived and/or modified sequence opt2 from anti-HIV_VRC-CH30_LightChain
  source 1..309: mol_type = other RNA
gacatccagatgacccagtccccctcctccctctccgcctccctcggcgaccgcgtcaccatcacctgccaggcctcccgcggcatcggcaaggacctcaactggtaccagcagaagcccggcaaggcccccaagctcctcgtctccgacgcctccatcctcgagggcggcgtcccctcccgcttctccggctccggcttccaccagaacttctccctcaccatctcctccctccagcccgaggacgtcgccacctacttctgccagcagtacgagaccttcggccagggcaccaaggtcgacatcaag

SEQ ID NO: 16541 - RNA, 393 nt, synthetic construct
  misc_feature 1..393: note = derived and/or modified sequence opt2 from anti-HIV_VRC-CH30_HeavyChain
  source 1..393: mol_type = other RNA
caggtccagctcgtccagtccggcgccgccgtccgcaagcccggcgcctccgtcaccgtctcctgcaagttcgccgaggacgacgactactccccccactgggtcaaccccgcccccgagcactacatccacttcctccgccaggcccccggccagcagctcgagtggctcgcctggatgaaccccaccaacggcgccgtcaactacgcctggcagctccacggccgcctcaccgccacccgcgacggctccatgaccaccgccttcctcgaggtccgctccctccgctccgacgacaccgccgtctactactgcgcccgcgcccagaagcgcggccgctccgagtgggcctacgcccactggggccagggcacccccgtcgccgtctcctcc

SEQ ID NO: 16542 - RNA, 309 nt, synthetic construct
  misc_feature 1..309: note = derived and/or modified sequence opt2 from anti-HIV_VRC-CH31_LightChain
  source 1..309: mol_type = other RNA
gacatccagatgacccagtccccctcctccctctccgcctccctcggcgaccgcgtcaccatcacctgccaggcctcccgcggcatcggcaaggacctcaactggtaccagcagaaggccggcaaggcccccaagctcctcgtctccgacgcctccaccctcgagggcggcgtcccctcccgcttctccggctccggcttccaccagaacttctccctcaccatctcctccctccaggccgaggacgtcgccacctacttctgccagcagtacgagaccttcggccagggcaccaaggtcgacatcaag

SEQ ID NO: 16543 - RNA, 393 nt, synthetic construct
  misc_feature 1..393: note = derived and/or modified sequence opt2 from anti-HIV_VRC-CH31_HeavyChain
  source 1..393: mol_type = other RNA
caggtccagctcgtccagtccggcgccgccgtccgcaagcccggcgcctccgtcaccgtctcctgcaagttcgccgaggacgacgactactccccctactgggtcaaccccgcccccgagcacttcatccacttcctccgccaggcccccggccagcagctcgagtggctcgcctggatgaaccccaccaacggcgccgtcaactacgcctggtacctcaacggccgcgtcaccgccacccgcgaccgctccatgaccaccgccttcctcgaggtcaagtccctccgctccgacgacaccgccgtctactactgcgcccgcgcccagaagcgcggccgctccgagtgggcctacgcccactggggccagggcacccccgtcgtcgtctcctcc

SEQ ID NO: 16544 - RNA, 309 nt, synthetic construct
  misc_feature 1..309: note = derived and/or modified sequence opt2 from anti-HIV_VRC-CH32_LightChain
  source 1..309: mol_type = other RNA
gacatccagatgacccagtccccctcctccctctccgcctccctcggcgaccgcgtcaccatcacctgccaggcctcccgcggcatcggcaaggacctcaactggtaccagcagaagcccggccgcgcccccaagctcctcgtctccgacgcctccatcctcgagggcggcgtccccacccgcttctccggctccggcttccaccagaacttctccctcaccatctcctccctccaggccgaggacgtcgccacctacttctgccagcagtacgagaccttcggccagggcaccaaggtcgacatcaag

SEQ ID NO: 16545 - RNA, 393 nt, synthetic construct
  misc_feature 1..393: note = derived and/or modified sequence opt2 from anti-HIV_VRC-CH32_HeavyChain
  source 1..393: mol_type = other RNA
caggtccagctcgtccagtccggcgccgccgtccgcaagcccggcgcctccgtcaccgtctcctgcaagttcgccgaggacgacgacttctccccccactgggtcaaccccgcccccgagcactacatccacttcctccgccaggcccccggccagcagctcgagtggctcgcctggatgaagcccaccaacggcgccgtcaactacgcctggcagctccagggccgcgtcaccgtcacccgcgaccgctcccagaccaccgccttcctcgaggtcaagaacctccgctccgacgacaccgccgtctactactgcgcccgcgcccagaagcgcggccgctccgagtgggcctacgcccactggggccagggcacccccgtcgtcatctccgcc

SEQ ID NO: 16546 - RNA, 309 nt, synthetic construct
  misc_feature 1..309: note = derived and/or modified sequence opt2 from anti-HIV_VRC-CH33_LightChain
  source 1..309: mol_type = other RNA
gacatccagatgacccagtccccctcctccctctccgcctccctcggcgaccgcgtcaccatcacctgccaggcctcccgcggcatcggcaaggacctcaactggtaccagcagaagcgcggccgcgccccccgcctcctcgtctccgacgcctccgtcctcgagggcggcgtcccctcccgcttctccggctccggcttccaccagaacttctccctcaccatctccaccctccagcccgaggacgtcgccacctacttctgccagcagtacgagaccttcggccagggcaccaaggtcgacatcaag

SEQ ID NO: 16547 - RNA, 393 nt, synthetic construct
  misc_feature 1..393: note = derived and/or modified sequence opt2 from anti-HIV_VRC-CH33_HeavyChain
  source 1..393: mol_type = other RNA
caggtccagctcgtccagtccggcgccgccgtccgcaagcccggcgcctccatctccgtctcctgcaagttcgccgacgccgacgactactccccccactggatgaaccccgcccccgagcactacatccacttcctccgccaggcccccggccagcagctcgagtggctcgcctggatgaaccccaccaacggcgccgtcaactacgcctggtacctcaacggccgcgtcaccgccacccgcgaccgctccatgaccaccgccttcctcgaggtccgctccctccgctccgacgacaccgccgtctactactgcgcccgcgcccagaagcgcgcccgctccgagtgggcctacgcccactggggccagggcacccccgtcgtcgtctcctcc

SEQ ID NO: 16548 - RNA, 309 nt, synthetic construct
  misc_feature 1..309: note = derived and/or modified sequence opt2 from anti-HIV_VRC-CH34_LightChain
  source 1..309: mol_type = other RNA
gacatccagatgacccagtccccctcctccctctccgcctccctcggcgaccgcgtcaccatcacctgccaggcctcccgcggcatcggcaaggacctcaactggtaccagcagaaggccggcaaggcccccaagctcctcgtctccgacgcctccatcctcgagggcggcgtcccctcccgcttctccggctccggcttccaccagaacttctccctcaccatctcctccctccagcccgaggacgtcgccacctacttctgccagcagtacgagaccttcggccagggcaccaaggtcgacatcaag

SEQ ID NO: 16549 - RNA, 393 nt, synthetic construct
  misc_feature 1..393: note = derived and/or modified sequence opt2 from anti-HIV_VRC-CH34_HeavyChain
  source 1..393: mol_type = other RNA
caggtccagctcgtccagtccggcgccgccgtccgcaagcccggcgcctccgtcaccgtctcctgcaagttcgccgaggacgacgactggtccccccactgggtcaaccccgcccccgagcactacatccacttcctccgccaggcccccggccagcagctcgagtggctcgcctggatgaaccccaccaacggcgccgtcaactacgcctggcagctcaacggccgcctcaccgccacccgcgacacctccatgaccaccgccttcctcgaggtcaagtccctccgctccgacgacaccgccgtctactactgcgcccgcgcccagaagcgcggccgctccgagtgggcctacgcccactggggccagggcacccccgtcgtcgtctcctcc

SEQ ID NO: 16550 - RNA, 306 nt, synthetic construct
  misc_feature 1..306: note = derived and/or modified sequence opt2 from anti-HIV_VRC-PG04_LightChain
  source 1..306: mol_type = other RNA
gagatcgtcctcacccagtcccccggcaccctctccctctcccccggcgagaccgcctccctctcctgcaccgccgcctcctacggccacatgacctggtaccagaagaagcccggccagccccccaagctcctcatcttcgccacctccaagcgcgcctccggcatccccgaccgcttctccggctcccagttcggcaagcagtacaccctcaccatcacccgcatggagcccgaggacttcgcccgctactactgccagcagctcgagttcttcggccagggcacccgcctcgagatccgccgc

SEQ ID NO: 16551 - RNA, 375 nt, synthetic construct
  misc_feature 1..375: note = derived and/or modified sequence opt2 from anti-HIV_VRC-PG04_HeavyChain
  source 1..375: mol_type = other RNA
caggtccagctcgtccagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccgacttccgccagcgcgtctccctcacccgcgaccgcgacctcttcaccgcccacatggacatccgcggcctcacccagggcgacaccgccacctacttctgcgcccgccagaagttctacaccggcggccagggctggtacttcgacctctggggccgcggcaccctcatcgtcgtctcctcc

SEQ ID NO: 16552 - RNA, 303 nt, synthetic construct
  misc_feature 1..303: note = derived and/or modified sequence opt2 from anti-HIV_VRC-PG04b_LightChain
  source 1..303: mol_type = other RNA
gagatcgtcctcacccagtcccccggcaccctctccctctcccccggcgagaccgcctccctctcctgcaccgccgcctcctacggccacatgacctggtaccagaagaagcccggccagccccccaagctcctcatcttcgccacctccaagcgcgcctccggcatccccgaccgcttctccggctcccagttcggcaagcagtacaccctcaccatcacccgcatggagcccgaggacttcgccggctactactgccagcaggtcgagttcttcggccagggcacccgcctcgagatccgc

SEQ ID NO: 16553 - RNA, 375 nt, synthetic construct
  misc_feature 1..375: note = derived and/or modified sequence opt2 from anti-HIV_VRC-PG04b_HeavyChain
  source 1..375: mol_type = other RNA
caggtccagctcgtccagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 16554 - RNA, 612 nt, synthetic construct
  misc_feature 1..612: note = derived and/or modified sequence opt2 from anti-HIV_VRC-PG20_LightChain
  source 1..612: mol_type = other RNA
cagtccgccctcacccagcccccctccgtctccggctcccccggccagtccatcaccctctcctgcaccggcgcctccacctccgtcgcctggtaccagcagtacgccgacaaggccccccgcctcatcgtcttcgacggcaacaagcgcccctccgacatctcctcccgcttctccggctcccagtccggcggcaccgcctccctcaccatctccggcctccagtccgaggacgaggcctactaccactgcaacgccttcgagttcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgc

SEQ ID NO: 16555 - RNA, 681 nt, synthetic construct
  misc_feature 1..681: note = derived and/or modified sequence opt2 from anti-HIV_VRC-PG20_HeavyChain
  source 1..681: mol_type = other RNA
gaggtccacctcatgcagtccggcaccgagatgaagaagcccggcgcctccgtccgcgtcacctgccagacctccggctacaccttctccgactacttcatccactggctccgccaggtccccggccgcggcttcgagtggatgggctggatgaacccccagtggggccaggtcaactacgcccgcaccttccagggccgcgtcaccatgacccgcgacgtctaccgcgaggtcgcctacctcgacctccgctccctcaccttcgccgacaccgccgtctacttctgcgcccgccgcatgcgctcccaggaccgcgagtgggacttccagcactggggccagggcacccgcatcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaag

SEQ ID NO: 16556 - RNA, 1059 nt, synthetic construct
  misc_feature 1..1059: note = derived and/or modified sequence opt2 from anti-HIV_VRC-PG20_G-Chain
  source 1..1059: mol_type = other RNA
gtctggaaggacgccgacaccaccctcttctgcgcctccgacgccaaggcccacgagaccgaggtccacaacgtctgggccacccacgcctgcgtccccaccgaccccaacccccaggagatccacctcgagaacgtcaccgagaacttcaacatgtggaagaacaacatggtcgagcagatgcaggaggacgtcatctccctctgggaccagtccctccagccctgcgtcaagctcaccggcggctccgtcatcaagcaggcctgccccaagatctccttcgaccccatccccatccactactgcacccccgccggctacgtcatcctcaagtgcaacgacaagaacttcaacggcaccggcccctgcaagaacgtctcctccgtccagtgcacccacggcatcaagcccgtcgtctccacccagctcctcctcaacggctccctcgccgaggaggagatcatcatccgctccgagaacctcaccaacaacgccaagaccatcatcgtccacctcaacaagtccgtcgagatcaactgcacccgcccctccaacggcggctccggctccggcggcgacatccgcaaggcctactgcgagatcaacggcaccaagtggaacaaggtcctcaagcaggtcaccgagaagctcaaggagcacttcaacaacaagaccatcatcttccagcccccctccggcggcgacctcgagatcaccatgcaccacttcaactgccgcggcgagttcttctactgcaacaccacccagctcttcaacaacacctgcatcggcaacgagaccatgaagggctgcaacggcaccatcaccctcccctgcaagatcaagcagatcatcaacatgtggcagggcaccggccaggccatgtacgccccccccatcgacggcaagatcaactgcgtctccaacatcaccggcatcctcctcacccgcgacggcggcgccaacaacacctccaacgagaccttccgccccggcggcggcaacatcaaggacaactggcgctccgagctctacaagtacaaggtcgtccagatcgag

SEQ ID NO: 16557 - RNA, 312 nt, synthetic construct
  misc_feature 1..312: note = derived and/or modified sequence opt2 from anti-HIV_VRC02_LightChain
  source 1..312: mol_type = other RNA
gagatcgtcctcacccagtcccccggcaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggccccgactacaacctcaccatccgcaacctcgagtccggcgacttcggcctctactactgccagcagtacgagttcttcggccagggcaccaaggtccaggtcgacatcaagcgc

SEQ ID NO: 16558 - RNA, 363 nt, synthetic construct
  misc_feature 1..363: note = derived and/or modified sequence opt2 from anti-HIV_VRC02_HeavyChain
  source 1..363: mol_type = other RNA
caggtccagctcgtccagtccggcggccagatgaagaagcccggcgagtccatgcgcatctcctgccaggcctccggctacgagttcatcgactgcaccctcaactgggtccgcctcgcccccggccgccgccccgagtggatgggctggctcaagccccgcggcggcgccgtcaactacgcccgccccctccagggccgcgtcaccatgacccgcgacgtctactccgacaccgccttcctcgagctccgctccctcaccgccgacgacaccgccgtctactactgcacccgcggcaagaactgcgactacaactgggacttcgagcactggggccgcggcacccccgtcaccgtctcctcc

SEQ ID NO: 16559 - RNA, 309 nt, synthetic construct
  misc_feature 1..309: note = derived and/or modified sequence opt2 from anti-HIV_VRC03_LightChain
  source 1..309: mol_type = other RNA
gagatcgtcctcacccagtcccccggcatcctctccctctcccccggcgagaccgccaccctcttctgcaaggcctcccagggcggcaacgccatgacctggtaccagaagcgccgcggccaggtcccccgcctcctcatctacgacacctcccgccgcgcctccggcgtccccgaccgcttcgtcggctccggctccggcaccgacttcttcctcaccatcaacaagctcgaccgcgaggacttcgccgtctactactgccagcagttcgagttcttcggcctcggctccgagctcgaggtccaccgc

SEQ ID NO: 16560 - RNA, 390 nt, synthetic construct
  misc_feature 1..390: note = derived and/or modified sequence opt2 from anti-HIV_VRC03_HeavyChain
  source 1..390: mol_type = other RNA
caggtccagctcgtccagtccggcgccgtcatcaagacccccggctcctccgtcaagatctcctgccgcgcctccggctacaacttccgcgactactccatccactgggtccgcctcatccccgacaagggcttcgagtggatcggctggatcaagcccctctggggcgccgtctcctacgcccgccagctccagggccgcgtctccatgacccgccagctctcccaggaccccgacgaccccgactggggcgtcgcctacatggagttctccggcctcacccccgccgacaccgccgagtacttctgcgtccgccgcggctcctgcgactactgcggcgacttcccctggcagtactggggccagggcaccgtcgtcgtcgtctcctcc

SEQ ID NO: 16561 - RNA, 630 nt, synthetic construct
  misc_feature 1..630: note = derived and/or modified sequence opt2 from anti-HIV_VRC23_LightChain
  source 1..630: mol_type = other RNA
gagatcgtcatgacccagtcccccgtcaccgtctccgtctcccgcggcggcaccgccaccctctcctgccgcgcctcccagggcgtcggctccgacgtcgcctggtaccagcacaagcccggccagaccccccgcctcctcatctacggcgcctccacccgcgcctccggcgtccccgagcgcttctccggctccggcttccacgtcgacttcaccctctccatctccggcctccagcccgaggacgtcgccatctactactgccagcagtacgagaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16562 - RNA, 672 nt, synthetic construct
  misc_feature 1..672: note = derived and/or modified sequence opt2 from anti-HIV_VRC23_HeavyChain
  source 1..672: mol_type = other RNA
gaggtccagttcgtccagtccggcgccgaggtcaagaagcccggcgcctccgtccgcgtctcctgcgaggcctccggctactccttcaccgactacgtcctccagtggatccgccaggcccccggccagcgccccgagtggatgggctggatcaagcccgagcgcggcgccgtctcctacgccccccagttccagggccgcctcaccctcacccgcgacctctacaccgagaccgcctacatgcacttcaagaacctccgctccgacgacaccgccatctactactgcgcccgcggcgtccgccgcgacgcctcctggtggctccagttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16563 - RNA, 1077 nt, synthetic construct
  misc_feature 1..1077: note = derived and/or modified sequence opt2 from anti-HIV_VRC23_G-Chain
  source 1..1077: mol_type = other RNA
gtctggcgcgacgccgacaccaccctcttctgcgcctccgacgccaaggcctacgagaccgagaagcacaacgtctgggccacccacgcctgcgtccccaccgaccccaacccccaggagatccacctcgacaacgtcaccgagaagttcaacatgtggaagaacaacatggtcgagcagatgcacaccgacatcatctccctctgggaccagtccctcaagccctgcgtcaagctcaccggcggctccgccatcacccaggcctgccccaaggtctccttcgagcccatccccatccactactgcacccccgccggcttcgccatcctcaagtgcaaggacgagggcttcaacggcaccggcctctgcaagaacgtctccaccgtccagtgcacccacggcatcaagcccgtcgtctccacccagctcctcctcaacggctccctcgccgagaagaacatcaccatccgctccgagaacatcaccaacaacgccaagatcatcatcgtccagctcgtccagcccgtcaccatcaagtgcatccgccccaacaacggcggctccggctccggcggcgacatccgccaggcccactgcaacgtcacccgctcccgctggaacaagaccctccaggaggtcgccgagaagctccgcacctacttcggcaacaagaccatcatcttcgccaactcctccggcggcgacctcgagatcaccacccactccttcaactgcggcggcgagttcttctactgcaacacctccggcctcttcaactccacctggtacgtcaactccacctggaacgacaccgactccacccaggagtccaacgacaccatcaccctcccctgccgcatcaagcagatcatcaacatgtggcagcgcgccggccaggccatgtacgccccccccatccccggcgtcatcaagtgcgagtccaacatcaccggcctcctcctcacccgcgacggcggcaaggacaacaacgtcaacgagaccttccgccccggcggcggcgacatgcgcgacaactggcgctccgagctctacaagtacaaggtcgtcgagatcgag

SEQ ID NO: 16564 - RNA, 648 nt, synthetic construct
  misc_feature 1..648: note = derived and/or modified sequence opt2 from anti-HIV_5CCK_LightChain
  source 1..648: mol_type = other RNA
cagtccgccctcacccagcccgcctccgtctccgcctcccccggccagtccatcaccatctcctgctccggcacccgctccgacgtcggcggctacgacttcgtctcctggtaccagcagcaccccggcaaggtccccaagctcatcatctacgaggtcaccaagcgcccctccggcatcccccagcgcttctccggctccaagtccggcaacaccgcctccctcaccatctccggcctccaggccgacgacgaggccgactactactgctgctcctacgccaactacgacaagctcatcctcggcggcggcaccaagctcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16565 - RNA, 696 nt, synthetic construct
  misc_feature 1..696: note = derived and/or modified sequence opt2 from anti-HIV_5CCK_HeavyChain
  source 1..696: mol_type = other RNA
caggtccagctcgtccagtccggcgccgagatgaaggaccccggcgcctccgtcaaggtctcctgccgcgcctccggctacaagttcaccgactactacatgcactgggtccgccaggcccccggccagggcctcgagtgggtcggctgggtcaacaccaacggcggcttcaccaagtacggcgccaagttccagggccgcgtcaccgtcacccgcgacacctccaccaacaccgtcttcctcgagctctcccgcctcaccttcggcgacaccgccatgtacttctgcgcccgccccatgcgccccgtctcccacggcatcgactactccggcctcttcgtcttccagttctggggccgcggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgac

SEQ ID NO: 16566 - RNA, 648 nt, synthetic construct; identical to SEQ ID NO: 16442
  misc_feature 1..648: note = derived and/or modified sequence opt2 from anti-HIV_5AWN_LightChain
  source 1..648: mol_type = other RNA

SEQ ID NO: 16567 - RNA, 696 nt, synthetic construct
  misc_feature 1..696: note = derived and/or modified sequence opt2 from anti-HIV_5AWN_HeavyChain
  source 1..696: mol_type = other RNA
caggtccagctcatgcagtccggcgcccagctccgcgaccccggcgactccctcaagatctcctgcaaggcctccggctacaacttcatcgactaccacatccactgggtccgcctcgcccccggccgcggcctcgagtggatgggctggatcgaccccgtcggcggcatcaccaagtacgccggccagttccagggccgcctctccctcacccgcgacacctccaccaacaccctcttcctcgagctctcccgcctcaccgccggcgacaccgccgtctacttctgcgcccgctccatgcgccccgtcgaccacggcatcgactactccggcctcttcgtcttccacttctggggccgcggctccgacgtcctcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgac

SEQ ID NO: 16568 - RNA, 645 nt, synthetic construct
  misc_feature 1..645: note = derived and/or modified sequence opt2 from anti-HIV_3QEG_LightChain
  source 1..645: mol_type = other RNA
gagatcgtcatgatgcagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctcccccgagaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16569 - RNA, 717 nt, synthetic construct
  misc_feature 1..717: note = derived and/or modified sequence opt2 from anti-HIV_3QEG_HeavyChain
  source 1..717: mol_type = other RNA
caggtccagctcgtccagtccggcgccgaggtcaagaagcccggctcctccgtcaaggtctcctgccgcgcctcccgcggcaccttctcctcctacggcatcacctgggtccgccaggcccccggccagggcctcgagtggatgggcggcatcatccccatcttcgacgtcaccaactacgcccagaacttccagggccgcgtcgccatcaccaccgacgccgagatgtccaccgcctacatggagctccgctccctcaagtccgaggactccgccgtctactactgcgcctccgactcccgcgacttctcctactacgagcccggcacctcctactcccactactacaacatcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccac

SEQ ID NO: 16570 - RNA, 690 nt, synthetic construct
  misc_feature 1..690: note = derived and/or modified sequence opt2 from anti-HIV_1N0X_K-Chain
  source 1..690: mol_type = other RNA
caggtccagctcgtccagtccggcgccgaggtcaagaagcccggcgcctccgtcaaggtctcctgccaggcctccggctaccgcttctccaacttcgtcatccactgggtccgccaggcccccggccagcgcttcgagtggatgggctggatcaacccctacaacggcaacaaggagttctccgccaagttccaggaccgcgtcaccttcaccgccgacacctccgccaacaccgcctacatggagctccgctccctccgctccgccgacaccgccgtctactactgcgcccgcgtcggcccctactcctgggacgactccccccaggacaactactacatggacgtctggggcaagggcaccaccgtcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16571 - RNA, 645 nt, synthetic construct
  misc_feature 1..645: note = derived and/or modified sequence opt2 from anti-HIV_1N0X_M-Chain
  source 1..645: mol_type = other RNA
gagatcgtcctcacccagtcccccggcaccctctccctctcccccggcgagcgcgccaccttctcctgccgctcctcccactccatccgctcccgccgcgtcgcctggtaccagcacaagcccggccaggccccccgcctcgtcatccacggcgtctccaaccgcgcctccggcatctccgaccgcttctccggctccggctccggcaccgacttcaccctcaccatcacccgcgtcgagcccgaggacttcgccctctactactgccaggtctacggcgcctcctcctacaccttcggccagggcaccaagctcgagcgcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctccgctcccccgtcaccaagtccttcaaccgcggcgagtgc

SEQ ID NO: 16572 - RNA, 654 nt, synthetic construct
  misc_feature 1..654: note = derived and/or modified sequence opt2 from anti-HIV_3QEH_HeavyChain
  source 1..654: mol_type = other RNA
gacatcgtcatgacccagtcccccctctccctccccgtcacccccggcgaggccgcctccatctcctgccgctcctcccagtccctcctccacaccaacggcttccagtacctcgactggtacctccagaagcccggccagtccccccagctcctcatctacctcggctccaaccgcgccaccggcgtcccccaccgcttctccggctccggctccggcaccgagttcaccctcaagatctcccgcgtcgaggccgaggacgtcggcgtctactactgcatgcaggccaaggagtcccccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16573 - RNA, 696 nt, synthetic construct
  misc_feature 1..696: note = derived and/or modified sequence opt2 from anti-HIV_3QEH_G-Chain
  source 1..696: mol_type = other RNA
caggtccagctcgtccagtccggcgccgaggtccgcaagcccggcgcctccgtcaccgtctcctgcaagacctccggctacaccttcgtcaacttctacatcgtctgggtccgccaggcccccggccagggcctcgagtggatgggcgtcatcaaccccttccgcggcgacacctacttcgcccagaagttcaagggccgcgtcaccctcacccgcgacacctccacctccaccgtcttcatggagctctcctccctccgctccgacgacaccgccatctactactgcgcccgcgacctcgagatgcgcgacggcaacaaccacggctcccacctcgagttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccac

SEQ ID NO: 16574 - RNA, 678 nt, synthetic construct
  misc_feature 1..678: note = derived and/or modified sequence opt2 from anti-HIV_2B1H_HeavyChain
  source 1..678: mol_type = other RNA
gagatccagctcgagcagtccggcgccgaggtcaagaagtccggcgagtccctcaagatctcctgccagacctccggctactccttctccgactactggatcggctgggtccgccagatgcccggcaagggcctcgagtggatgggcatcttctaccccggcgactccgactcccgctactccccctccttcgagggccaggtcaccatgtccgccgaccgctccaccaacaccgcccacctccagtggtcctccctcaagccctccgacaccgccctctactactgcgcccgcctcggcggcgactacgaggactccggcgccgacgccttcgacttctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcc

SEQ ID NO: 16575 - RNA, 645 nt, synthetic construct
  misc_feature 1..645: note = derived and/or modified sequence opt2 from anti-HIV_2B1H_LightChain
  source 1..645: mol_type = other RNA
cagtccgtcctcacccagcccccctccgcctccggcacccccggccagcgcatctccatctcctgctccggcacctcctccaacgtcgagaacaactacgtctactggtaccagcacctccccggcaccgcccccaagctcctcatctaccgcaacgaccaccgctcctccggcatccccgaccgcttctccgcctccaagtccggcacctccgcctccctcgccatctccggcctccgccccgaggacgagggcgactactactgcgccgcctgggacgactcccgcggcggccccgactgggtcttcggcggcggcaccaagctcaccgtcctcgcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccacc

SEQ ID NO: 16576 - RNA, 648 nt, synthetic construct
  misc_feature 1..648: note = derived and/or modified sequence opt2 from anti-HIV_3TNM_B-Chain
  source 1..648: mol_type = other RNA
cagtccgtcctcacccagcccccctccgcctccggctcccccggccagtccgtcaccatctcctgcaccggcacctcctccgacgtcggcggctacaactacgtctcctggtaccagcaccaccccggcaaggcccccaagctcatcatctccgaggtcaacaaccgcccctccggcgtccccgaccgcttctccggctccaagtccggcaacaccgcctccctcaccgtctccggcctccaggccgaggacgaggccgagtactactgctcctcctacaccgacatccacaacttcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 16577 - RNA, 693 nt, synthetic construct
  misc_feature 1..693: note = derived and/or modified sequence opt2 from anti-HIV_3TNM_A-Chain
  source 1..693: mol_type = other RNA
caggtccagctccaggagtccggccccggcctcgtcaagccctcccagaccctctccctctcctgcaccgtctccggcggctcctcctcctccggcgcccactactggtcctggatccgccagtaccccggcaagggcctcgagtggatcggctacatccactactccggcaacacctactacaacccctccctcaagtcccgcatcaccatctcccagcacacctccgagaaccagttctccctcaagctcaactccgtcaccgtcgccgacaccgccgtctactactgcgcccgcggcacccgcctccgcaccctccgcaacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacc

SEQ ID NO: 16578 - RNA, 690 nt, synthetic construct
  misc_feature 1..690: note = derived and/or modified sequence opt2 from anti-HIV_3UJJ_HeavyChain
  source 1..690: mol_type = other RNA
gaggtccagctcgtccagtccggcgccgaggtcaagaagcccggcgagtccctcaagatctcctgcaaggcctccggctactccttctcctcctactggatcgcctgggtccgccagatgcccggcaagggcctcgagtggatgggcttcatctaccccgccgactccgacacccgctactccccctccttccagggccagggcaccatctccgccgacaagtccatctccaccgcctacctccagtggtcctccctcaaggcctccgacaccgccatgtactactgcgccatcctcggcttctggggcgccaaccgcggcggcggcggcatggacgtctggggccagggcaccaccgtcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacc

SEQ ID NO: 16579 - RNA, 639 nt, synthetic construct
  misc_feature 1..639: note = derived and/or modified sequence opt2 from anti-HIV_3UJJ_LightChain
  source 1..639: mol_type = other RNA
tcctacgagctcacccagcccccctccgtctccgtctcccccggccagaccgcccgcatcacctgctccggcgacgccctccccgagaagtacgcctactggtaccagcagaagtccggccaggcccccgtcctcatcatctacgaggactccaagcgcccctccggcatccccgagcgcttctccggctcccgctccggcaccatggccaccctcaccatctccggcgcccaggtcgacgacgaggccgactactactgctactccaccaactccggcggcaccttcttcgtcttcggcaccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgc

SEQ ID NO: 16580 - RNA, 669 nt, synthetic construct
  misc_feature 1..669: note = derived and/or modified sequence opt2 from anti-HIV_3UJI_HeavyChain
  source 1..669: mol_type = other RNA
caggtccagctcgtccagtccgccgccgaggtcaagaagcccggcgaggccctcaagatctcctgcaagggctccggctactccttctccaactactggatcgcctgggtccgccagatgcccggcaagggcctcgagtggatgggcatcgtctaccccgacgactccgactcctcctacaactcctccttccagggccagatcaccttctccgccgacaagtccatctccaccgcctacctccactggacctccctccaggcctccgacaccgccatgtactactgcgcccgcctcggcttcgagggcgactactccggctccttcttcgactactggggccagggcaccctcctcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccc

SEQ ID NO: 16581 - RNA, 627 nt, synthetic construct
  misc_feature 1..627: note = derived and/or modified sequence opt2 from anti-HIV_3UJI_LightChain
  source 1..627: mol_type = other RNA
tcctacgagctcacccagcccccctccgtctccgtctcccccggccagaccgcctccatcacctgctccggcgacatcctcggcgacaagtacgtctcctggtaccagcagaagtccggccagtcccccctcctcgtcatctacgaggacaccaagcgcccctccggcatccccgaccgcttctccggctccaagtccggcaacaccgccaccctcaccatctccggcacccaggccatggacgaggccgactactactgccaggcctgggactccaccctcggcgtcgtcttcggcggcggcaccaaggtcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgccccc

SEQ ID NO: 16582 - RNA, 666 nt, synthetic construct
  misc_feature 1..666: note = derived and/or modified sequence opt2 from anti-HIV_2QSC_HeavyChain
  source 1..666: mol_type = other RNA
caggtccagctcgtccagtccggcggcggcctcgtccagcccggcggctccctccgcctctcctgcgccgccttcggcttcaacttctcctcctacgtcatgcactgggtccgccaggcccccggccagggcctcgagtacctctccgccatctcctccgacggcgagaccacctaccacgccaactccgtcaagggccgcttcacctcctcccgcgacaactccaagaacaccctcttcctccagatgggctccctccgcaccgaggacgtcgccgtctactactgcgcccgcgaccgctactacgagacctccggctccaacgccttcgacgtctggggccagggcaccatggtcgtcgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgag

SEQ ID NO: 16583 - RNA, 645 nt, synthetic construct
  misc_feature 1..645: note = derived and/or modified sequence opt2 from anti-HIV_2QSC_LightChain
  source 1..645: mol_type = other RNA
aactccgtcctcacccagtccccctcctccctctccgcctccgtcggcgaccgcgtcaccatcacctgccaggcctcccaggacatctccaactacctcaactggtaccagcacaagcccggcaaggcccccaagctcctcatctacaccgcctccaacctcgagaccggcgtcccctcccgcttctccggcggcggctccggcacccacttctccttcaccatcacctccctccagcccgaggacgccgccacctacttctgccagcagtacgacaacctcggcgacctctccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16584 - RNA, 690 nt, synthetic construct
  misc_feature 1..690: note = derived and/or modified sequence opt2 from anti-HIV_3MLZ_HeavyChain
  source 1..690: mol_type = other RNA
caggtccagctccaggagtccggccccggcctcgtcaagccctccgagaccctctccctcacctgcaccgtctccggcggctccatctccggcttccactggtcctggatccgccagccccccggcaagggcctcgagtacatcggctacatctactactccggctccacctcctacaacccctccctcaagtcccgcgtctccatgtccgtcgacacctcccgcaaccagttctccctcgagctctcctccgtcaccgccgccgacaccgccgtctactactgcgcccgcgacttcggcgagtaccactacgacggccgcggcttccagtgcgagggcttcgacctctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16585 - RNA, 642 nt, synthetic construct
  misc_feature 1..642: note = derived and/or modified sequence opt2 from anti-HIV_3MLZ_LightChain
  source 1..642: mol_type = other RNA
cagtccgtcctcacccagcccccctccgtctccgccgcccccggccagaaggtcaccatctcctgctccggctcctcctccaacatcggcaacaacatggtctcctggtaccagcagcaccccggcaccgcccccaagctcctcatctacgagaactccaagcgcccctccggcatccccgaccgcttctccggctcccgctccggcacctccgccaccctcggcatcatcggcctccagaccggcgacgaggccgagtactactgcgccacctgggacggctccctccgcaccgtcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtccgcgccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgc

SEQ ID NO: 16586 - RNA, 684 nt, synthetic construct
  misc_feature 1..684: note = derived and/or modified sequence opt2 from anti-HIV_3MLX_I-Chain
  source 1..684: mol_type = other RNA
caggtccagctccaggagtccggccccggcctcgtcaagccctccgagaccctctccctcacctgcaccgtctccggcggctccatctccggcttccactggtcctggatccgccagccccccggcaagggcctcgagtacatcggctacatctactactccggctccacctcctacaacccctccctcaagtcccgcgtctccatgtccgtcgacacctcccgcaaccagttctccctcgagctctcctccgtcaccgccgccgacaccgccgtctactactgcgcccgcgacttcggcgagtaccactacgacggccgcggcttccagtgcgagggcttcgacctctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 16587 - RNA, 633 nt, synthetic construct
  misc_feature 1..633: note = derived and/or modified sequence opt2 from anti-HIV_3MLX_M-Chain
  source 1..633: mol_type = other RNA
tccgtcctcacccagcccccctccgtctccgccgcccccggccagaaggtcaccatctcctgctccggctcctcctccaacatcggcaacaacatggtctcctggtaccagcagcaccccggcaccgcccccaagctcctcatctacgagaactccaagcgcccctccggcatccccgaccgcttctccggctcccgctccggcacctccgccaccctcggcatcatcggcctccagaccggcgacgaggccgagtactactgcgccacctgggacggctccctccgcaccgtcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtccgcgccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccacc

SEQ ID NO: 16588 - RNA, 684 nt, synthetic construct
  misc_feature 1..684: note = derived and/or modified sequence opt2 from anti-HIV_3MLW_I-Chain
  source 1..684: mol_type = other RNA
caggtccagctcgtccagtccggcgccgaggtcaagaaggccggcgagtccctcgagatctcctgcaagggctccggctacaccttcaccgaccactggatcgcctgggtccgccaggtccccggcaagggcctcgagtggatgggcatgatctaccccggcgactccgacacccgctactccccctccctccagggccgcgtcaccatgtccgccgacaagaccctctccaccgcctacctccagtggtcccgcctcgaggcctccgacaccgccatgtactactgcgcccgcctccactactccgaccgctccggctcctacttcaacgacgtcttccacatgtggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcc

SEQ ID NO: 16589 - RNA, 645 nt, synthetic construct
  misc_feature 1..645: note = derived and/or modified sequence opt2 from anti-HIV_3MLW_M-Chain
  source 1..645: mol_type = other RNA
cagtccgtcctcacccagcccccctccgcctccggcacccccggccagcgcgtcaccatctcctgctccggcaactcctccaacatcgagaacaactacgtctactggtaccagcagctccccggctccacccccaagctcctcatcttccgcgacgaccagcgcccctccggcgtccccgaccgcttctccggctccaagtccggcacctccgcctccctcgccatctccggcctccgctccgaggacgaggccgactactactgcgcctcctgggacgactcccgcggcggccccgactacgtcttcggcaccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccacc

SEQ ID NO: 16590 - RNA, 678 nt, synthetic construct
  misc_feature 1..678: note = derived and/or modified sequence opt2 from anti-HIV_3MLV_N-Chain
  source 1..678: mol_type = other RNA
gaggtccagctcgtcgagtccggcggcgaggtcaagcagcccggccagtccctcaagatctcctgcaagtcctccggctacaacttcctcgactcctggatcggctgggtccgccagatccccggcaagggcctcgagtggatcggcatcatctaccccgacgactccgacgcccactactccccctccttcgagggccaggtcaccatgtccgtcgacaagtccatctccaccgcctacctccagtggaccaccctccaggcctccgacaccggcaagtacttctgcacccgcctctacctcttcgagggcgcccagtcctccaacgccttcgacctctggggccagggcaccatgatcctcgtctcctccggcaccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcc

SEQ ID NO: 16591 - RNA, 657 nt, synthetic construct
  misc_feature 1..657: note = derived and/or modified sequence opt2 from anti-HIV_3MLV_M-Chain
  source 1..657: mol_type = other RNA
tcctacctcctcacccagcccccctccgtctccgtctcccccggccagaccgcctccatctcctgctccggcgacaagctcgacgacaagtacgtctcctggtactaccagcgccccggccagtcccccgtcctcctcatgtaccaggacttcaagcgcccctccggcatccccgagcgcctctccggctccaagtccggcaagaccgccaccctcaccatctccggcacccagtccctcgacgagggcgactactactgccaggcctgggacgcctccaccggcgtctccggcggcggcaccaagctcaccgtcctcttcggcgagggcacccgcctcaccgtcctcgcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccacc

SEQ ID NO: 16592 - RNA, 654 nt, synthetic construct
  misc_feature 1..654: note = derived and/or modified sequence opt2 from anti-HIV_3MLU_LightChain
  source 1..654: mol_type = other RNA
tacctcctcacccagcccccctccgtctccgtctcccccggccagaccgcctccatctcctgctccggcgacaagctcgacgacaagtacgtctcctggtactaccagcgccccggccagtcccccgtcctcctcatgtaccaggacttcaagcgcccctccggcatccccgagcgcctctccggctccaagtccggcaagaccgccaccctcaccatctccggcacccagtccctcgacgagggcgactactactgccaggcctgggacgcctccaccggcgtctccggcggcggcaccaagctcaccgtcctcttcggcgagggcacccgcctcaccgtcctcgcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccacc

SEQ ID NO: 16593 - RNA, 657 nt, synthetic construct
  misc_feature 1..657: note = derived and/or modified sequence opt2 from anti-HIV_3MLT_G-Chain
  source 1..657: mol_type = other RNA
tcctacgacctcacccagcccccctccgtctccgtctcccccggccagaccgcctccatctcctgctccggcgacaagctcgacgacaagtacgtctcctggtactaccagcgccccggccagtcccccgtcctcctcatgtaccaggacttcaagcgcccctccggcatccccgagcgcctctccggctccaagtccggcaagaccgccaccctcaccatctccggcacccagtccctcgacgagggcgactactactgccaggcctgggacgcctccaccggcgtctccggcggcggcaccaagctcaccgtcctcttcggcgacggcacccgcctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccacc

SEQ ID NO: 16594 - RNA, 666 nt, synthetic construct
  misc_feature 1..666: note = derived and/or modified sequence opt2 from anti-HIV_3GO1_HeavyChain
  source 1..666: mol_type = other RNA
gaggtccagctccaggagtccggccccggcctcgtcaagccctccgagaccctctccctcacctgcaccgtctccggcggccccatcaacaacgcctactggacctggatccgccagccccccggcaagggcctcgagtacctcggctacgtctaccacaccggcgtcaccaactacaacccctccctcaagtcccgcctcaccatcaccatcgacacctcccgcaagcagctctccctctccctcaagttcgtcaccgccgccgactccgccgtctactactgcgcccgcgagtgggccgaggacggcgacttcggcaacgccttccacgtctggggccagggcaccatggtcgccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagccc

SEQ ID NO: 16595 - RNA, 627 nt, synthetic construct
  misc_feature 1..627: note = derived and/or modified sequence opt2 from anti-HIV_3GO1_LightChain
  source 1..627: mol_type = other RNA
tcctacgtcctcacccagcccccctccgtctccgtctcccccggccagaccgcccgcatcacctgctccgccgaggccctctccaaccagtacgcctactggtaccgccagcgccccggccaggcccccctcctcatcatctacaaggacaccaagcgcccctccggcatccccgagcgcttctccggctccacctccggcaccaccgtcaccctcaccatctccggcgtccaggccgaggacgaggccgactactactgccagtccgccgactcctccggcgactacgtcttcggcggcggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgccccc

SEQ ID NO: 16596 - RNA, 690 nt, synthetic construct
  misc_feature 1..690: note = derived and/or modified sequence opt2 from anti-HIV_4XCY_J-Chain
  source 1..690: mol_type = other RNA
caggtccagctcgtccagtccggcgccgaggtcaagcgccccggctcctccgtcaccgtctcctgcaaggcctccggcggctccttctccacctacgccctctcctgggtccgccaggcccccggccgcggcctcgagtggatgggcggcgtcatccccctcctcaccatcaccaactacgccccccgcttccagggccgcatcaccatcaccgccgaccgctccacctccaccgcctacctcgagctcaactccctccgccccgaggacaccgccgtctactactgcgcccgcgagggcaccaccggctggggctggctcggcaagcccatcggcgccttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 16597 - RNA, 645 nt, synthetic construct
  misc_feature 1..645: note = derived and/or modified sequence opt2 from anti-HIV_4XCY_K-Chain
  source 1..645: mol_type = other RNA
gagatcgtcctcacccagtcccccggcacccagtccctctcccccggcgagcgcgccaccctctcctgccgcgcctcccagtccgtcggcaacaacaagctcgcctggtaccagcagcgccccggccaggccccccgcctcctcatctacggcgcctcctcccgcccctccggcgtcgccgaccgcttctccggctccggctccggcaccgacttcaccctcaccatctcccgcctcgagcccgaggacttcgccgtctactactgccagcagtacggccagtccctctccaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 16598 - RNA, 630 nt, synthetic construct
  misc_feature 1..630: note = derived and/or modified sequence opt2 from anti-HIV_4YBL_C-Chain
  source 1..630: mol_type = other RNA
gtcctcacccagcccccctccgcctccggctcccccggccagtccgtcaccatctcctgcaccggcacctcctccgacgtcggcggctacaactacgtctcctggtaccagcaccaccccggcaaggcccccaagctcatcatctccgaggtcaacaaccgcccctccggcgtccccgaccgcttctccggctccaagtccggcaacaccgcctccctcaccgtctccggcctccaggccgaggacgaggccgagtactactgctcctcctacaccgacatccacaacttcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgccccc

SEQ ID NO: 16599 - RNA, 672 nt, synthetic construct
  misc_feature 1..672: note = derived and/or modified sequence opt2 from anti-HIV_4YBL_B-Chain
  source 1..672: mol_type = other RNA
caggtccagctccaggagtccggccccggcctcgtcaagccctcccagaccctctccctctcctgcaccgtctccggcggctcctcctcctccggcgcccactactggtcctggatccgccagtaccccggcaagggcctcgagtggatcggctacatccactactccggcaacacctactacaacccctccctcaagtcccgcatcaccatctcccagcacacctccgagaaccagttctccctcaagctcaactccgtcaccgtcgccgacaccgccgtctactactgcgcccgcggcacccgcctccgcaccctccgcaacgccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaag

SEQ ID NO: 16600 - RNA, 630 nt, synthetic construct
  misc_feature 1..630: note = derived and/or modified sequence opt2 from anti-HIV_4R4N_X-Chain
  source 1..630: mol_type = other RNA
gacatccagatgacccagtccccctccttcgtctccgcctccgtcggcgaccgcgtcaccatcacctgccgcgcctcccagggcatctcctcctacctcgcctggtaccagcagaagcccggcaaggcccccaagctcgtcatctacgccgcctccaccctccagtccggcgtcccctcccgcttctccggctccggctccggcaccgagttcaccctcaccatctcctccctccagcccgaggacttcgccacctactactgccagcacctcatcggcctccgctccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 16601 - RNA, 660 nt, synthetic construct
  misc_feature 1..660: note = derived and/or modified sequence opt2 from anti-HIV_4R4B_F-Chain
  source 1..660: mol_type = other RNA
caggtccagctccagcagtggggcgccggcctcctcaagccctccgagaccctctccctcacctgcggcgtctacggcgagtccctctccggccactactggtcctgggtccgccagccccccggcaagcgcctcgagtggatcggcgagatcaagcacaacggctcccccaactaccacccctccctcaagtcccgcgtcaccatctccctcgacatgtccaagaaccagttctccctcaacctcacctccgtcaccgccgccgacaccgccgtctacttctgcgcccgccgctccaactggccctacctccccttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 16602 - RNA, 750 nt, synthetic construct
  misc_feature 1..750: note = derived and/or modified sequence opt2 from anti-HIV_3JUY_D-Chain
  source 1..750: mol_type = other RNA
caggtccagctcgtccagtccggcgccgaggtcaagaagcccggcgcctccgtcaaggtctcctgccaggcctccggctaccgcttctcccacttcaccgtccactgggtccgccaggcccccggccagcgcttcgagtggatgggctggatcaacccctacaacggcaacaaggagttctccgccaagttccaggaccgcgtcaccttcaccgccgacacctccgccaacaccgcctacatggagctccgctccctccgctccgccgacaccgccgtctactactgcgcccgcgtcggcgagtggggctgggacgactccccctacgacaactactacatggacgtctggggcaagggcaccaccgtcatcgtctcctccggcggcggcggctccggcggcggcggctccggcggcggcggctccgagatcgtcctcacccaggcccccggcaccctctccctctcccccggcgagcgcgccaccttctcctgccgctcctcccactccatccgctcccgccgcgtcgcctggtaccagcacaagcccggccaggccccccgcctcgtcatccacggcgtctccaaccgcgcctccggcatctccgaccgcttctccggctccggctccggcaccgacttcaccctcaccatcacccgcgtcgagcccgaggacttcgccctctactactgccaggtctacggcgcctcctcctacaccttcggccagggcaccaagctcgagcgcaag

SEQ ID NO: 16603 - RNA, 369 nt, synthetic construct
  misc_feature 1..369: note = derived and/or modified sequence opt2 from anti-HIV_4KG5_HeavyChain
  source 1..369: mol_type = other RNA
cagctcgtccagtccggccccgaggccaagcgccccggctcctccgtcaaggtctcctgcaaggcctcccgcgacaccttcaacaactacgtcctcaactgggtccgccaggcccccggccagggcctcgagtggatgggcggcatcggccccatcatcgagaccgccgactacgccgagaagttccgcggccgcctctccatcaccgccgacgagtccaccaccaccgcctacatggagctctcctccctcacctccgacgacaccgccgtctactactgcgcccgctccccctactcctccctcaccgacacctactactactacatggacctctggggcaagggcaccaccgtcaccgtctcctcc

SEQ ID NO: 16604 - RNA, 336 nt, synthetic construct
  misc_feature 1..336: note = derived and/or modified sequence opt2 from anti-HIV_4KG5_LightChain
  source 1..336: mol_type = other RNA
ctcacccagtcccccgactccctcgccgtctccctcggcgagcgcgccaccatcaactgcaagtcctcccagtccatcctcgactcctccaacaaccgcaactacctcacctggtaccagcagaagcccggccagccccccaagctcctcatctactgggcctccacccgcgagtccggcgtccccgaccgcttctccggctccggctcctccaccgacttcaccctcaccatctcctccctccaggccgaggacgtcgccgtctactactgccagcagtacttctccacccccggcatcaccttcggccagggcacccgcctcgagatcaagcgc

SEQ ID NO: 16605 - RNA, 309 nt, synthetic construct
  misc_feature 1..309: note = derived and/or modified sequence opt2 from anti-HIV-1_LightChain
  source 1..309: mol_type = other RNA
gagatcgtcctcacccagtcccccgccaccctctccctctcccccggcgagcgcgccaccctctcctgccgcgcctcccagtccgtctacaccaagctcgcctggtaccagcagaagcccggccagcccccccgcctcctcatctacgacgcctccaaccgcgccgccggcatccccgcccgcttctccggctccggctccggcaccgagttcaccctcaccatcaagcgcatggagcgcgaggacttcgccgtctactactgccagatcctcgagttcttcggccagggcaccaccatcgacatgaac

SEQ ID NO: 16606 - RNA, 312 nt, synthetic construct
  misc_feature 1..312: note = derived and/or modified sequence opt2 from anti-HIV-1_LightChain
  source 1..312: mol_type = other RNA
gacatccagatgacccagtccccctcctccgtctccgcctccgtcggcgaccgcgtcaccatcacctgccgcgcctcccagggcatcctctcctcccagctcgcctggcaccagcagcgccgcggccagcccccccgcctcctcatctacggcggctccaaccgcgcccccggcatccccgagcgcttcaccggctccggctccggcaccgacttcgtcctcaccatcaagcgcctccagcgcgacgacttcgccgtctactactgccagatcctcgagttcttcggccgcggcacccgcgtcgagatgaac

SEQ ID NO: 16607 - RNA, 312 nt, synthetic construct
  misc_feature 1..312: note = derived and/or modified sequence opt2 from anti-HIV-1_LightChain
  source 1..312: mol_type = other RNA
ggcctcctcctcacccagtcccccggccccgtctccttcttccccggcgagcgcgccaccgtctcctgccgcgcctcccactccgtcaactccgccgccatcaactggtaccagcagaagcgcggccagcccccccgcctcatcatcgtcgacggctccacccgcgccaccgccgtccccgagcgcttctccgccaccggctccggcaccgagttcaccctcgtcatctcccgcctcgagcccgaggacttcgccgtctacttctgccagcacctccagttcttcggcctcggcaccaaggtcgacatcaag

SEQ ID NO: 16608 - RNA, 312 nt, synthetic construct
  misc_feature 1..312: note = derived and/or modified sequence opt2 from anti-HIV-1_LightChain
  source 1..312: mol_type = other RNA
gccttcgtcatgacccagtcccccggcaccctcgccctctcccccggcgagcgcgccaccctctcctgccgcacctcccaggagatcctctccaaccagctcgcctggcaccagcagcgccgcggccagcccccccgcctcctcatctacggcggctccaaccgcgcccccggcatccccgagcgcttcaccggctccggctccggcaccgacttcgtcctcaccatcaaccgcctcgagcgcgacgacttcgccgtctactactgccagatcctcgagttcttcggccgcggcacccgcgtcgagatgaac

SEQ ID NO: 16609 - RNA, 312 nt, synthetic construct
  misc_feature 1..312: note = derived and/or modified sequence opt2 from anti-HIV-1_LightChain
  source 1..312: mol_type = other RNA
ggcatcgtcctcacccagtcccccgacaccctctccctctcccccggcgaccgcgccaccctctcctgcaagacctcccagtccatcgcctccgagcacctcgcctggtaccagcagcgccccggccagcccccccgcctcctcatcttcggcgcctccaaccgcgcctccggcatccccacccgcttctccggctccggctccggcgccgacttcaccctctccatcacccgcctcgagcccgaggacttcgccgtctactactgccagttctccgagttcttcggccgcggcgcccgcgtcgaggtcaag

SEQ ID NO: 16610 - RNA, 312 nt, synthetic construct
  misc_feature 1..312: note = derived and/or modified sequence opt2 from anti-HIV-1_LightChain
  source 1..312: mol_type = other RNA
cagttcgtcatgacccagtcccccgccaccctctcctcctcccccggcggcaccgccaccctctcctgccgcacctcccactccatcctcaactcccagctcgcctggcaccagcagcgccgcggccagcccctccgcctcctcatctacggcgcctccaaccgcgcccccggcatccccgagcgcttctccgcctccggctccggcaccgagttcgtcctcaccatcaagcgcatggagcgcgaggacttcgccgtctactactgccagatcctcgagttcttcggccagggcaccaccatcgacatgaac

SEQ ID NO: 16611 - RNA, 354 nt, synthetic construct
  misc_feature 1..354: note = derived and/or modified sequence opt2 from anti-HIV-1_HeavyChain
  source 1..354: mol_type = other RNA
cgcgtccacctcgtccagtccggcacccaggtcaagaagcccggcgcctccgtcaaggtctcctgcgagacctccggcttcaagttcctcgactccctcatccactgggtccgccaggcccccggccagggcctctactggatgggctggatcaagccctaccgcggctccgtcaactacgacggctacttccgcggccgcgtctccatgacccgcgacatctacaccgacaccgcctacctcgagctctccggcctccgctccgacgacaccgccatctactactgcgccttcggcgccggcgacggctgggacctcgtctggggccagggcaccctcgtcatcgtctcctcc

SEQ ID NO: 16612 - RNA, 354 nt, synthetic construct
  misc_feature 1..354: note = derived and/or modified sequence opt2 from anti-HIV-1_HeavyChain
  source 1..354: mol_type = other RNA
cgcgtccacctcgtccagtccggcacccaggtcaagaagcccggcgcctccgtcaaggtctcctgcgagacctccggcttcaagttcctcgactccctcatccactgggtccgccaggcccccggccagggcctctactggatgggctggatcaagcccttccgcggctccgtcaactacgacggctacttccgcggccgcgtctccatgacccgcgacatctacaccgacaccgcctacatggagctctccggcctccgctccgacgacaccgccatctactactgcgccttcggcgccggcgacggctgggacctcgtctggggccagggcaccctcgtcatcgtctcctcc

SEQ ID NO: 16613 - RNA, 354 nt, synthetic construct
  misc_feature 1..354: note = derived and/or modified sequence opt2 from anti-HIV-1_HeavyChain
  source 1..354: mol_type = other RNA
caggtccacctcgtccagtccggcacccaggtcaagaagcccggcgcctccgtccgcgtctcctgcgagacctccggcttcaagttcctcgactccatcatccactggttccgccaggcccccggcgagggcctcttctggatgggctggatcaagccctacaccggctccgtcaactacgtccgccgctaccagggccgcgtctccatgacccgcgacgtctactccgacaccgcctacatggacctctccggcctcaactccgacgacaccgccgtctacttctgcacctacggcgccggcgacggctggaacctcgtctggggccagggcaccctcgtcatcgtctccgcc

SEQ ID NO: 16614 - RNA, 363 nt, synthetic construct
  misc_feature 1..363: note = derived and/or modified sequence opt2 from anti-HIV-1_HeavyChain
  source 1..363: mol_type = other RNA
caggtccgcctcgtccagtccggcaaccaggtccgcaagcccggcgcctccgtccgcatctcctgcgaggcctccggctacaagttcatcgaccacttcatccactgggtccgccaggtccccggccacggcctcgagtggctcggctggatcaacccccgcggcggcggcgtcaactactcccgcggcttccagggcaagctctccatgaccatgacccgcgacaacttcgaggagaccgcctacctcgacctctcccgcctcaaccccggcgacaccgccgtctactactgcgcccgcggcttcgccggctacgagtggtccttcctctggggccagggcaccctcgtcatcgtctcctcc

SEQ ID NO: 16615 - RNA, 357 nt, synthetic construct
  misc_feature 1..357: note = derived and/or modified sequence opt2 from anti-HIV-1_HeavyChain
  source 1..357: mol_type = other RNA
caggtctccctcgtccagtccggcaaccagctcaagaagcccggcgcctccgtccgcatctcctgcgagacctccggctacaacttcctcaaccacttcatccactgggtccgccaggtccccggccacggcctcgagtggctcggctggatcaacccccgcggcggcggcgtcaactactcccgcaacttccagggcaaggtctccctcacccgcaacatcgacatggagaccgtctacctcgacgtccgcggcctcacccccggcgacaccgccgtctactactgcgcccgcggcttcggcggctccgactggaacttcgtctggggccagggcacccgcatcaccgtctccgcc

SEQ ID NO: 16616 - RNA, 357 nt, synthetic construct
  misc_feature 1..357: note = derived and/or modified sequence opt2 from anti-HIV-1_HeavyChain
  source 1..357: mol_type = other RNA
cgcatcaacctccaccagtccggctcccaggtcaagcgctccggcgcctccgtccgcatctcctgcgagacctccggcttcaagttcatggactcccacctccactgggtccgccaggtcgccggccagggcttcgagtggatgggctggatcttcacctccggcggcggcgtcaactacgcccgccagttccagggccgcctcaccctcacccgcgacgtcttcaccgacaccgtcttcatggacctctccggcgtcaacgtcggcgacaccggcgtctactactgcgtcaagggcaccggcggcaacgagtggggcttctcctggggccagggcaccgtcgtcgtcgtctccccc

SEQ ID NO: 16617 - RNA, 357 nt, synthetic construct
  misc_feature 1..357: note = derived and/or modified sequence opt2 from anti-HIV-1_HeavyChain
  source 1..357: mol_type = other RNA
cgcatcaacctcgaccagtccggctcccaggtcaagaagtccggcgcctccgtccgcatctcctgcgagacctccggcttcaagttcatggactcccacctccactgggtccgccaggtcgccggccagcccttcgagtggatgggctggatcttcacctccggcggcggcgtcaactacgcccgccagttccagggccgcctcaccctcacccgcgacgtcttctccgagaccgtcttcatggacctctccggcctcaacgccggcgacaccggcgtctacttctgcgtcaagggcaccggcggcaacgagtggggcttcgtctggggccagggcaccgtcgtcgtcgtctccccc

SEQ ID NO: 16618 - RNA, 357 nt, synthetic construct
  misc_feature 1..357: note = derived and/or modified sequence opt2 from anti-HIV-1_HeavyChain
  source 1..357: mol_type = other RNA
cgcatcgagctccaccagtccggctcccaggtcaagaagtccggcgcctccgtccgcatctcctgcgagacctccggcttcaagttcatggactcccacctccactgggtccgccaggtcgccggccagcgcttcgagtggatgggctggatcttcacctccggcggcggcgtcaactacgcccgccagttccagggccgcctccgcctcacccgcgacgtcttctccgagtccgtcttcatggacctctccggcctcaactccggcgacaccggcgtctactactgcgtcaagggcaccggcggcaacgagtggggcttcgtctggggccagggctccctcgtcgtcgtctccccc

SEQ ID NO: 16619 - RNA, 372 nt, synthetic construct
  misc_feature 1..372: note = derived and/or modified sequence opt2 from anti-HIV-1_HeavyChain
  source 1..372: mol_type = other RNA
caggccctcgtccagtccggctcccagatgaagaagcccggcgactccgtccgcctctcctgccagacctccgactccgccatcaccaagtacttcatccactggatccgccaggcccccggcaagggcctcgagtggatcgcctggatctccccctacggcggccgcgtcaactacggctggcaggtccgcgaccgcgccaccctcacccgcaacatccacatggagaccgtctacatggacctccgcggcctccgccccgacgacaccgccacctactactgcgccatgcgcgactactgccgcgacgacaactgcaaccgctgggacctcggccactggggccagggctccctcatcgtcgtctccgcc

SEQ ID NO: 16620 - RNA, 357 nt, synthetic construct
  misc_feature 1..357: note = derived and/or modified sequence opt2 from anti-HIV-1_HeavyChain
  source 1..357: mol_type = other RNA
caggtcaccctcgtccagtccggcaaccagctcaagcgccccggcgcctccgtccgcatctcctgcgagacctccggctacaacttcatggaccacttcatccactgggtccgccaggtccccggccacggccccgagtggctcggctgggtcaacccccgcggcggcggcgtcaactactcccgcaagttccagggccgcttctccatgacccgcgacgtctacatggagaccgcctacctcgacgtcaccggcctctcccccgccgacaccgccgtctactactgcgcccgcggcttcggcggctccgactggtccttcctctggggccagggcaccctcatcatcgtctcctcc

SEQ ID NO: 16621 - RNA, 324 nt, synthetic construct
  misc_feature 1..324: note = derived and/or modified sequence opt2 from anti-HIV-1_LightChain
  source 1..324: mol_type = other RNA
gagatcgtcctcacccagtcccccggcaccctctccctctccgccggcgagcgcgcctccctctcctgccgcgcctcccagaccctcaactccaacttcttcgcctggtaccaccagaagcccggccaggccccccgcctcctcatctacggcgcctccaaccgcgccaccggcatccccgaccgcttctccggctccggctccggctccgacttcaccctcaccatctcccgcctcgagcccgaggacttcggcaagtactactgcgagcagtacgacgtctccccccgcaccttcggccagggcaccaaggtcgagatcaag

SEQ ID NO: 16622 - RNA, 324 nt, synthetic construct
  misc_feature 1..324: note = derived and/or modified sequence opt2 from anti-HIV-1_LightChain
  source 1..324: mol_type = other RNA
gaggtcgtcctcacccagtcccccggcaccctctccctctcccccggcgagcgcgccaccctctcctgccgcgcctcccagtccatcaactccaacttcttcgcctggtaccaccagaagcccggccaggccccccgcctcctcatctacggcgcctcctcccgcgccaccggcatccccgaccgcatctccggcaccggctccggcgccgacttcaccctcaccatcaccggcctcgagcccgaggacttcggcctctactactgccagcagtacgacttctccccccgcaccttcggccagggcacccgcgtcgagatcaag

SEQ ID NO: 16623 - RNA, 324 nt, synthetic construct
  misc_feature 1..324: note = derived and/or modified sequence opt2 from anti-HIV-1_LightChain
  source 1..324: mol_type = other RNA
gaggtcgtcctcacccagtcccccggcaccctctccctctcccccggcgagcgcgccaccctctcctgccgcgcctcccagaccatcaactccaacttcttcgcctggtaccaccagaagcccggccaggccccccgcctcctcatctacggcgcctcctcccgcgccaccggcatccccgaccgcatctccggctccggctccggcaccgacttcaccctcaccatcaccggcctcgagcccgaggacttcggcctctactactgccagcagttcgacttctccccccgcaccttcggccagggcacccgcgtcgagatcaag

SEQ ID NO: 16624 - RNA, 324 nt, synthetic construct
  misc_feature 1..324: note = derived and/or modified sequence opt2 from anti-HIV-1_LightChain
  source 1..324: mol_type = other RNA
gagatcgtcctcacccagtcccccggcaccctctccctcgcccccggcgagcgcgccaccctctcctgccgcgcctcccagtccatctccaccacctacctcgcctggtaccagcagaagcccggccaggccccccgcctcctcatctacgagacctcctcccgcgcctccgacatccccgaccgcttctccggctccggctccggcaccgacttcaccctcaccatctcccgcctcgagcccgaggacttcgccgtctactactgccaccagtacgaccgctccccccgcaccttcggccagggcaccaaggtcgagatcaag

SEQ ID NO: 16625 - RNA, 336 nt, synthetic construct
  misc_feature 1..336: note = derived and/or modified sequence opt2 from anti-HIV-1_LightChain
  source 1..336: mol_type = other RNA
gacatcgtcatgacccagtcccccgcctccctctccgtcacccccggcgagaccgcctccatctcctgcaagtgctcccgctccctccgcgaggaggtcggctacaactacctcgactggtacctccagcgccccggcaagtccccccagctcctcatctacgtcggctccttccgcgcccccggcgtctccgagcgcttccgcggctccggcgagcacaaggacttcaccctcaagatcgcccgcgtcgagcccggcgacgccggcatctactactgcatgcagggcatcgacaccccccgcaccttcggccagggcaccaccctcgagatcaac

SEQ ID NO: 16626 - RNA, 321 nt, synthetic construct
  misc_feature 1..321: note = derived and/or modified sequence opt2 from anti-HIV-1_LightChain
  source 1..321: mol_type = other RNA
gacatccagatgacccagtccccctcctccctctccgcctccgtcggcgaccgcgtcaccatcacctgccgcgcctcccaggccttccgcaacgacctcggctggtaccagcacaagcccggcaaggcccccgagcgcctcatctacgccacctccaccctcgagtccggcgtcccctcccgcttctccggctccggctccggcaccaacttcaccctcaccatctcctccctccaggccgaggacttcgccacctactactgcctccagtacaacaccttcccccgcaccttcggccagggcaccaaggtcgagatcaag

SEQ ID NO: 16627 - RNA, 333 nt, synthetic construct
  misc_feature 1..333: note = derived and/or modified sequence opt2 from anti-HIV-1_LightChain
  source 1..333: mol_type = other RNA
aacttcatgctcacccagccccactccgtctccgagtcccccggcaagaccgtcaccatctcctgcgcccgcacccgcggcggcatcgactccgcctacgtccactggtaccagcagcgccccggctccgtccccaccaccgtcatcttcgaggacaaccgccgcccccccggcgtccccgaccgcttctccggctccatcgacacctcctccaacaccgcctccctcaccatctccggcctcaagaccgaggacgaggccgactactactgccagtcctacgacgacacctacttctgggtcttcggcggcggcaccaagctcaccgtcctc

SEQ ID NO: 16628 - RNA, 333 nt, synthetic construct
  misc_feature 1..333: note = derived and/or modified sequence opt2 from anti-HIV-1_LightChain
  source 1..333: mol_type = other RNA
aacttcatgctcacccagccccactccgtctccgagtcccccggcaagaccgtcaccatctcctgcgcccgcacccgcggcaccatcgactccgcctacgtccactggtaccagcagcgccccggcgccgtccccaccaccgtcatcttcgaggacgaccgccgcccctccggcgtccccgaccgcttctccggctccatcgactcctcctccaactccgcctccctcaccatctccggcctcaagaccgaggacgaggccgactactactgccagtcctacgactccaactactactgggtcttcggcggcggcaccaagctcaccgtcctc

SEQ ID NO: 16629 - RNA, 396 nt, synthetic construct
  misc_feature 1..396: note = derived and/or modified sequence opt2 from anti-HIV-1_HeavyChain
  source 1..396: mol_type = other RNA
caggtccagctccagcagtccggccccgccctcgtcaagccctccgagaccctctccctcacctgctccgtctcctccggccgcgtctcctcctactactggtcctggatccgccagtcccccggcaagggcctcgagtggatcggctacatccactacgaccccgacaccaacaccaactaccgcacccactaccacccctccctccgcggccgcgtcgtcatctccgtcgactcctccaagtcccaggtctccctcaaggtccgctccgtcaccgccgccgactccgccctctactactgcgcccgccaccgctacgacccctggtccaagggctacgacatccgctcccccttcgacttctggggccagggcaccctcgtcaccgtctcctcc

SEQ ID NO: 16630 - RNA, 396 nt, synthetic construct
  misc_feature 1..396: note = derived and/or modified sequence opt2 from anti-HIV-1_HeavyChain
  source 1..396: mol_type = other RNA
caggtccacctccagcagtccggccccggcctcgtcaagccctccgagaccctctccctcacctgcaccgtctccggcggccgcgtctcctcctactactggtcctggatccgccagtcccccggcaagggcctcgagtggatcggctacatccactacgaccccgacacctccaccaactaccgcacccactaccacccctccctccgcggccgcgtcgtcatctccgtcgacacctccaagaaccaggtctccctcaccgtccgctccgtcaccgccgccgactccgccctctactactgcgcccgccaccgctacgacgtctggtccaacggctacgacatccgctccccctacgacttctggggccgcggcaccctcgtcaccgtctcctcc

SEQ ID NO: 16631 - RNA, 396 nt, synthetic construct
  misc_feature 1..396: note = derived and/or modified sequence opt2 from anti-HIV-1_HeavyChain
  source 1..396: mol_type = other RNA
caggtccacctcgagcagtccggccccgccctcgtcaagccctccgagaccctctccctcacctgcaccgtctccggcggccgcgtctcctcctactactggtcctggatccgccagtcccccggcaagggcctcgagtggatcggctacatccactacgaccccgacacctccaccaactaccgcacccactaccacccctccctccgcggccgcgtcgtcatctccgtcgactcctccaagaaccaggtctccctcaaggtccgctccgtcaccgccgccgactccgccctctactactgcgcccgccaccgctacgacgtctggtccaagggctacgacatccgctcccccttcgacttctggggccgcggcaccctcgtcaccgtctcctcc

SEQ ID NO: 16632 - RNA, 390 nt, synthetic construct
  misc_feature 1..390: note = derived and/or modified sequence opt2 from anti-HIV-1_HeavyChain
  source 1..390: mol_type = other RNA
caggtcgtcttccagaagcccggccccggcgtcgtcaagccctccgagaccctctccctcacctgcaccgtctccggcggccgcgtccgctcctactactggtcctggatccgcctcccccccggccagggcctcgagtggatcggctacatccactacgacgagaccaccgagtacaagcgctcctacaacccctccctcaagtcccgcatcaccatctccatggacacctccaagaaccaggtctccctcaagctctcctccgtcaccgccgccgacgccgccgtctactactgcgcccgccaccgctacgaccgctggtccgactcctacgacatccgctcccccttcgacatctggggccagggcaccgtcgtcaccgtctccgcc

SEQ ID NO: 16633 - RNA, 396 nt, synthetic construct
  misc_feature 1..396: note = derived and/or modified sequence opt2 from anti-HIV-1_HeavyChain
  source 1..396: mol_type = other RNA
caggtccagctccagcagtggggcgccggcctcctcaagccctccgagaccctctccctcacctgcgccatctacggctcctccttctccggccactactggatgtggatccgccagtcccccgccaagaccctcgagtggatcgccgagatcaaccacaccggcggcacccgctacaacccctccctcgcctcccgcgtccgcgtcttctccgacacctccaagaaccagttctccctcaacatgacctccctcaccgccgccgacaccggcatctactactgcgtccgcggccacctctcccgcgaccgcctcggccagtacgccttctggtccggcgccctcatcgactacctcgacccctggggccagggcaccctcgtcaccgtctcctcc

SEQ ID NO: 16634 - RNA, 387 nt, synthetic construct
  misc_feature 1..387: note = derived and/or modified sequence opt2 from anti-HIV-1_HeavyChain
  source 1..387: mol_type = other RNA
caggtccagctccaccagtggggcgccggcctcctcaagccctccgagaccctctccctcacctgcgccgtctacggctccttcaccggcttccagtggacctgggtccgccagacccccggcaagggcctcgagtggatcggcgagatcaaccactccggcctcctcgtcaccggcaagaccgactacaacccctccctcgagtcccgcgtcaccatctccgtcgacacctccaagaaccagttctccctcaagctcacctccgtcaccgccgccgacaccggcgtctactactgcgcccgcgccggcggcatgtccgactgggcctacccctactactacggcatggacgtctggggccagggcaccatggtcaccgtctcctcc

SEQ ID NO: 16635 - RNA, 357 nt, synthetic construct
  misc_feature 1..357: note = derived and/or modified sequence opt2 from anti-HIV-1_HeavyChain
  source 1..357: mol_type = other RNA
caggtccagctcgtcgagtccggcggcggcgtcgtccagcccggccgctccctcaccctctcctgcgccacctccggcttcgacttctcctcctacggcttccactgggtccgccaggcccccggcaagggcctccagtgggtctccatcatctcccacgacggctccatcaagaactacggcgactccatgaagggccgcttctccgtctcccgcgacaacgccaaggacatcctctacctccagatgaactccctccgccccgacgacaccgccctctaccactgcgtccgcggcgacggcgagaacggcggcaccgactactggggcctcggcaccctcgtcaccgtctccgcc

SEQ ID NO: 16636 - RNA, 357 nt, synthetic construct
  misc_feature 1..357: note = derived and/or modified sequence opt2 from anti-HIV-1_HeavyChain
  source 1..357: mol_type = other RNA
caggtcgacctcgtcgagtccggcggcggcgtcgtccagcccggcaagtccctcaagctctcctgcaccgcctccggcttcaccttcacctcctacggcatgcactgggtccgccagatccccggcaagggcctcgagtgggtcgccatcatctcccacgacggcaccatcaagaactacggcgactccgtcaagggccgcttcaccatctcccgcgacaacgccatgaacatcctctacctccagatgaacaacctccgcggcgacgacaccgccctctactactgcgtccgcggcgacggcgagaacggcggcaccgactactggggccagggcaccgtcgtcaccgtctcctcc

SEQ ID NO: 16637 - RNA, 369 nt, synthetic construct
  misc_feature 1..369: note = derived and/or modified sequence opt2 from anti-HIV_V3_HeavyChain
  source 1..369: mol_type = other RNA
gaggtccagctcgtccagtccggcgccgaggtcaagaagcccggcgagtccctcaagatctcctgccagggcttcggctacaccttctccacctactggatcggctgggtccgccagatgcccggcaagggcctcgagtggctcggcatcatctaccccgaggactccgagaccatctactccccctccttccagggccaggccaccatctccgccgacaagtccctctccaccgcctacctccagtggtccggcctccgcgcctccgactccgccatctactactgcgcccgcctcggctactgcggctccacctcctgctccttcttcgacttctggggccgcggcaccctcgtcaccgtctcctcc

SEQ ID NO: 16638 - RNA, 369 nt, synthetic construct
  misc_feature 1..369: note = derived and/or modified sequence opt2 from anti-HIV_V3_HeavyChain
  source 1..369: mol_type = other RNA
gaggtccagctcgtccagtccggcgccgaggtcaccaagcccggcgagtccctcaagatctcctgcaagggctccggctactccttctccacccactggatcgcctgggtccgccagatgcccggccgcggcctcgagtggatgggcttcatctaccccgacgactccgacacccgctactccccctccctccagggccacgtcatcatctccgccgacaagtccctctccaccgcctacctccagtggtcctccctcaaggcctccgacaccgccatgtactactgcgcccgcctcggcggcgacgagtaccagtcctccggcggcatggacgtctggggccagggcaccaccgtcatcgtctcctcc

SEQ ID NO: 16639 - RNA, 393 nt, synthetic construct
  misc_feature 1..393: note = derived and/or modified sequence opt2 from anti-HIV_V3_HeavyChain
  source 1..393: mol_type = other RNA
gaggtccagctcgtccagtccggcgccgaggtcaagaagcccggcgccaccgtcaagatctcctgcaaggtctccggctacaccctcaccgactactacatccactgggtccagcaggcccccggccgcggcctcgagtggctcggcctcgtcgaccccgagaacggcgagaccctctacgccgagaagttccagggccgcgtcaccctcaccgccgacacctccaccgacaccgcctacatggagctcaagtccctccgctacgaggacaccgccgtctactactgcgccaccgagggccccccctcctactacgactccggcacctacgccaagtccctccccgcctccttcgcctgctggggccagggcaccctcgtcaccgtctcctcc

SEQ ID NO: 16640 - RNA, 369 nt, synthetic construct
  misc_feature 1..369: note = derived and/or modified sequence opt2 from anti-HIV_V3_HeavyChain
  source 1..369: mol_type = other RNA
caggtccagctccaggagtccggccccggcctcgtcaagccctccgagaccctctccctcacctgcaccgtctccggcggctccatcaacaactactactggtcctggatccgccagccccccggcaagggcctcgagtacatcggctacatcttctactccggctccaccaactacaacccctccctcaagtcccgcgtcaccttctccgtcgacacctccaagaaccagttctccctcaagctcacctccgtcaccgccaccgacaccgccgtctactactgcgcccgcggccccctcctctacttcggcgccccccgcacccacttcgactactggggccagggcgccctcgtcaccgtctcctcc

SEQ ID NO: 16641 - RNA, 372 nt, synthetic construct
  misc_feature 1..372: note = derived and/or modified sequence opt2 from anti-HIV_V3_HeavyChain
  source 1..372: mol_type = other RNA
gaggtccagctcgtccagtccggcgccgaggtcaagaagcccggcgagtccctcaagatctcctgcaagggctccggctactccttctcctcccactggatcggctgggtccgccagctccccggcaagggcctcgagtggatgggcatcatctaccccgacgactccgacaccaagtacaacccctccttccagggccaggtcaccatctccgccgaccgctccatctccaccgcctacctccagtggtcctccctcaaggcctccgacaccgccatgtactactgcgcccgcgtcggctacgactcctacggctactccggctccaacttcgacgagtggggccagggcaccctcgtcaccgtctcctcc

SEQ ID NO: 16642 - RNA, 357 nt, synthetic construct
  misc_feature 1..357: note = derived and/or modified sequence opt2 from anti-HIV_V3_HeavyChain
  source 1..357: mol_type = other RNA
gaggtccagctcgtccagtccggcgccgaggtcaagaagcccggcgagtccctcaagatctcctgcaagggctccggctacaacttcaactccgactggatcggctgggtccgccagatgcccggcaagggcctcgagtgggtcggcatgatctaccccgacgacttcgaggtccgccactccccccccttccagggccgcgtcaccatgtccgtcgacaagtccatctccaccgcctacctccagtggtcctccctcaagtcctccgacaccggcatgtacttctgcgcccgcctcgacggcaacgccgccgccttcgactactggggccagggcacccaggtcaccgtctcctcc

SEQ ID NO: 16643 - RNA, 360 nt, synthetic construct
  misc_feature 1..360: note = derived and/or modified sequence opt2 from anti-HIV_V3_HeavyChain
  source 1..360: mol_type = other RNA
gacgtccagctcgtccagtccggcgccgaggtcaagaaggccggcgagtccctcaagatctcctgccgcccctccggctacaacttcgccgactactggatcggctgggtccgccagatgcccggcaagggcctcgagtggatgggcatcatcttccccgacgactccgacacccgctacggcccctccttcgagggccaggtcaccatctccgccgacaagtccatcaacaccgcctacctccagtggaactccctcaaggcctccgacaccgccatgtacttctgcgcccgccacggcggctccggcgccgcccccggcgactactggggccagggcaccctcgtcaccgtctcctcc

SEQ ID NO: 16644 - RNA, 363 nt, synthetic construct
  misc_feature 1..363: note = derived and/or modified sequence opt2 from anti-HIV_V3_HeavyChain
  source 1..363: mol_type = other RNA
gaggtccagctcgtccagtccggcgccgaggtcaagaagcccggcgccaccgtcaagatctcctgcaaggtctccggctacaccttcaccgactacttcatgcactgggtccaggaggcccccggcaagggcctcgcctggatgggcctcgtcgaccccgagaacggcgacaccgtctacgccgagaagctccagggccgcgtcaccatgtccgccgacacctcccgcgacaccgcctacatggagctcacctccctccgctccgaggacaccgccgtctactactgcgccatcggcaagtccgtcgccggcacctccgcctacgacatctggggccagggcaccatggtcaccgtctcctcc

SEQ ID NO: 16645 - RNA, 369 nt, synthetic construct
  misc_feature 1..369: note = derived and/or modified sequence opt2 from anti-HIV_V3_HeavyChain
  source 1..369: mol_type = other RNA
caggtccagctcgtccagtccggcgccgaggtccgcaagcccggcgcctccgtcaaggtctcctgcaaggcctccggcgacaccttcaacaaccacgacatcaactgggtccgccaggcccccggccagggccccgagtgggtcggctggatgaaccccaagtccggcaacgccggctacgcccagaagttccagggccgcgtcaccatgacccgcgacacctccatctccaccgcctacatggagctccgctccctcacctccgaggacaccggcgtctactactgcgcccgcctcaccgtcgactgcgacgacggcggctgctacggcgactactggggccagggcaccctcgtcaccgtctcctcc

SEQ ID NO: 16646 - RNA, 354 nt, synthetic construct
  misc_feature 1..354: note = derived and/or modified sequence opt2 from anti-HIV_V3_HeavyChain
  source 1..354: mol_type = other RNA
gaggtctacctccagcagtccggcgccgagctcaaggagcccggcgccaacgtcaagatctcctgcaaggccttcggcttcatcttcaccgactacttcatccactggctccgccaggcccccggcaagggcccccagtgggtcggcgtcgtcgaccccgaggacggctccaccacctacgccgaggccttccagggccgcgtctccatcaccgccgaccgctccaccgacaccgcctacatggacctcgccggcctcacctccgacgacaccgccgtctactactgcgccctcatgtggaacgagtccggccccgacaactggggccagggcaccctcgtcatcgtctcctcc

SEQ ID NO: 16647 - RNA, 393 nt, synthetic construct
  misc_feature 1..393: note = derived and/or modified sequence opt2 from anti-HIV_V3_HeavyChain
  source 1..393: mol_type = other RNA
gaggtccaggtcgtcgagttcggcggcgaggtcaagaagcccggcgcctccgtcaaggtctcctgcgaggcctccggctacaccttcgccaagttcgccatccactgggtccgccaggccccccgccagggcctcgagtggatgggctggatcaacggcgacgacggcaagaccgagtactcccagaagttccaggaccgcgtcaccatgacccgcgacacctccgcctccaccgtctacatggagctctcctccctccgctccgaggacaccgccctctactactgcgcccgcgccatgtaccccgacaccgtcaccggcaacgacaaccccgcccccccccccttcgagggcgactactggggccagggcaccctcgtcaccgtctcctcc

SEQ ID NO: 16648 - RNA, 393 nt, synthetic construct
  misc_feature 1..393: note = derived and/or modified sequence opt2 from anti-HIV_V3_HeavyChain
  source 1..393: mol_type = other RNA
gaggtccagctcgtcgagtccggcggcggcctcgtcaagcccggcggctccctccgcctcacctgcgtcgcctccggcttcaccttctccgacgtctggctcaactgggtccgccaggcccccggcaagggcctcgagtgggtcggccgcatcaagtcccgcaccgacggcggcaccaccgactacgccgcctccgtcaagggccgcttcaccatctcccgcgacgactccaagaacaccctctacctccagatgaactccctcaagaccgaggacaccgccgtctactcctgcaccaccgacggcttcatcatgatccgcggcgtctccgaggactactactactactacatggacgtctggggcaagggcaccaccgtcaccgtctcctcc

SEQ ID NO: 16649 - RNA, 387 nt, synthetic construct
  misc_feature 1..387: note = derived and/or modified sequence opt2 from anti-HIV_CD4bs_HeavyChain
  source 1..387: mol_type = other RNA
gaggagcagctcgtcgagtccggcggcggcctcgtcaagcccggcggctcccagcgcctctcctgcgccgcctccgagttcaccttctcccgctacaccatgaactgggtccgccaggcccccggcaagggcctcgagtgggtctcctccatctccggcaacgacaacaacatctactacgccgactccgtcaagggccgcttcaccatctcccgcgacaacgcccgcaactccctctacctccagatcaactccctccgcgtcgaggacaccgccgtctactactgcgcccgcggccccctcgactcctacgacttctggtccggctcccgccactactacggcctcgacgtctggggccagggcaccaccgtcaccgtctcctcc

SEQ ID NO: 16650 - RNA, 372 nt, synthetic construct
  misc_feature 1..372: note = derived and/or modified sequence opt2 from anti-HIV_CD4bs_HeavyChain
  source 1..372: mol_type = other RNA
caggtccagctcgtccagtccggctccgagctcaagaagcccggcgcctccgtcaaggtctcctgcaaggcctccggctacaccttcacctcccacatcatcaactgggtccgccaggcccccggccagggcctcgagtggatgggctggatcaacaccaacaccggcaaccccacctacgcccagggcttcaccggccgcttcgtcttctccctcgacacctccgtctccatggcctacctccagatctcctccctcaaggccgaggacaccggcgtctactactgcgcccgcggcttccgccagtggctcgtcgcccgcatcacctacttcgactactggggccagggcaccctcgtcaccgtctcctcc

SEQ ID NO: 16651 - RNA, 369 nt, synthetic construct
  misc_feature 1..369: note = derived and/or modified sequence opt2 from anti-HIV_CD4bs_HeavyChain
  source 1..369: mol_type = other RNA
gagctccgcctccaggcctccggccccggcctcgtcaagccctccgagaccctctccctcgtctgctccgtctccggcgtctccatctccgactcctactggaactggatccgccagcccgccggcaagggcctcgagtggatcggccgcgtctacacccgcggcacccacacctacaacccctccctcggcggccgcgccaccgtctccggcgacaccaacaagaacgaggtctccctcaagctcatgtccgtcaccgccgccgacaccgccgtctactactgcgcccgcgccctctccggcgactggacccgccgctacttctacatggacgtctggggccgcggcacccccgtcaccgtctcctcc

SEQ ID NO: 16652 - RNA, 381 nt, synthetic construct
  misc_feature 1..381: note = derived and/or modified sequence opt2 from anti-HIV_CD4bs_HeavyChain
  source 1..381: mol_type = other RNA
cagctccagctccaggagtccggcccccgcctcgtcaagccctccgagaccctctccctcacctgcaccgtctccggcggctccatctcctccggcgactactactggacctggatccgccagccccccggcgagggcctcgagtacatcggctacatctactccggcggctccaccgactacaacccctccctcaagtcccgcgcctccatctcccaggacacctccaccaacgagttctccctcaagctcacctccgtcaccgccgccgacaccgccgtctacttctgcgcccgcgaccgccgcgtcctcctctggttcggcgagccccgccgcggcctcgacttctggggccccggcaccctcgtcaccgtctcctcc

SEQ ID NO: 16653 - RNA, 396 nt, synthetic construct
  misc_feature 1..396: note = derived and/or modified sequence opt2 from anti-HIV_CD4bs_HeavyChain
  source 1..396: mol_type = other RNA
gaggtccagctcgtcgagtccggcggcggcctcgtcaagcccggcggctccctccgcctctcctgcgccgcctccggcttcaccttctcctccgcctggatgtcctgggtccgccaggcccccggcaagggcctcgagtgggtcggccgcatcaagtccaagtccgacggcgagaccaccgactacgccgcccccgtcaagggccgcttcaccatctcccgcgacaacctcgagtccaccctctacctccagctcaactccctcaagaccgaggacaccgccgtctactactgcgccaccgccaccccctcctactacgacatcatgaccggcaactacaagtactactactacatggacgtctggggcaagggcaccaccgtcaccgtctcctcc

SEQ ID NO: 16654 - RNA, 363 nt, synthetic construct
  misc_feature 1..363: note = derived and/or modified sequence opt2 from anti-HIV_CD4bs_HeavyChain
  source 1..363: mol_type = other RNA
caggtccagctcgtcgagtccggcggcggcctcgtcaagcccggcggctccctccgcctctcctgcgccgcctccggcttcatcttccgcgaccactacatgacctggatccgccaggcccccggcaagggcctcgagtgggtctcctacatctcctcctcctccaacaacatccagtacgccgactccgtcaagggccgcttcaccgtctcccgcgacaacgccaagaactccctctacctccagatgaactccctccgcgccgacgacaccgccgtctactactgcgcccgctccggccccttctacaactacggcccccccaacaactggggccagggcaccctcgtcaccgtctcctcc

SEQ ID NO: 16655 - RNA, 378 nt, synthetic construct
  misc_feature 1..378: note = derived and/or modified sequence opt2 from anti-HIV_CD4bs_HeavyChain
  source 1..378: mol_type = other RNA
caggtccagctcgtcgagtccggcggcggcgtcgtccagcccggcggctccctcaccctctcctgcaccgcctccggcttccccttcaactcctacgccatgcactgggtccgccaggcccccggcaagggcctcgagtgggtctccatgacctcccacgacggcggcaacaaggacttcgtcgactccgtcaagggccgcttcaccatctcccgcgacaactcccgcaacaccctcttcctccagatgaactccctctcccaggacgacaccggcgtctactactgcgtccgcggcaagctcgaggactacaacttctggggccactaccgcgacttcgactcctggggccagggcaccctcgtcaccgtctccgcc

SEQ ID NO: 16656 - RNA, 405 nt, synthetic construct
  misc_feature 1..405: note = derived and/or modified sequence opt2 from anti-HIV_CD4bs_HeavyChain
  source 1..405: mol_type = other RNA
gagccccacgtcgtcgagtccggcggcggcatggccaagcccggcggctccctccgcctctcctgcgccggctccggcttcaccttcaccaacgcctggatgaactgggtccgccaggcccccggcaagggcctcgagtgggtcggcctcatcaagtccaagtccgacggcggcaccaccgactacgccgccgacgtcgagggccgcttcaccatctcccgcgacgacctcgagtccaccatgttcctcgagatgcactccctccagatcgaggacaccgccgtctacttctgcaccacccagtacccccgctactacgacctcatgaccggcaactacaagcgccgctacttctcctccggcatggacgtctggggccagggcaccgccgtcaccgtctcctcc

SEQ ID NO: 16657 - RNA, 384 nt, synthetic construct
  misc_feature 1..384: note = derived and/or modified sequence opt2 from anti-HIV_CD4bs_HeavyChain
  source 1..384: mol_type = other RNA
caggtccagctccaggagtccggccccggcctcgtcaagccctcccagaccctctccctcacctgcaccgtctccggcgactccgtctcctccggcaactactactggtcctggatccgccagcccgccggcaagcccctcgagtggatcggccacatctccaccggcggcggcaccaagaacaacccctccctccagtcccgcgtcaccatctccctcgactcctccaagaaccaggtctccctctccctctcctccgtcaccgccgccgacaccgccgtctacacctgcgcccgcggccccccccgctccctctggttcggcgaccccacctactcctacatggacgtctggggcaagggcaccaccgtcaccgtctcctcc

SEQ ID NO: 16658 - RNA, 372 nt, synthetic construct
  misc_feature 1..372: note = derived and/or modified sequence opt2 from anti-HIV_CD4bs_HeavyChain
  source 1..372: mol_type = other RNA
caggtccagctcgtccagtccggcgccgaggtcaagaagcccggctcctccgtcaaggtctcctgcaaggcctccggcggcaccttcaactcccacgccttcacctgggtccgccaggcccccggccagggcctcgagtggatgggcggcatcatccccaccctcggcctcgccaacgacgcccagaagttccagggccgcttcaccatcaccgccgacgagtccaccaccaccgtctacatggagctctcctccctccgctccgaggacaccgccgtctactactgcgcccgccgcccctactacgaccaggtctccggcgtcggcgccttcgacatctggggccagggcacccgcgtcaccgtctcctcc

SEQ ID NO: 16659 - RNA, 390 nt, synthetic construct
  misc_feature 1..390: note = derived and/or modified sequence opt2 from anti-HIV_V2_HeavyChain
  source 1..390: mol_type = other RNA
caggtccagctcgtccagtccggcgccgaggtcaagaagcccggctcctccgtcaaggtctcctgcgaggcctccggcgtcacctcctcctcctacaccatctcctgggtccgcctcgcccccggccagggcctcgagtggatgggccgcatcacccccatcttcgacatcaccaactacgcccagaagttccagggccgcgtcaccctcaccgccgacaagtccaccggcaccacctacatggagctctcctccctccgctccgacgacaccgccgtctactactgcgcccgcgacaagtccgacgtcgtcgtcgtcacctccatccgccccgcctactactacggcatggacgtctggggccagggcaccaccgtcaccgtctcctcc

SEQ ID NO: 16660 - RNA, 366 nt, synthetic construct
  misc_feature 1..366: note = derived and/or modified sequence opt2 from anti-HIV_V2_HeavyChain
  source 1..366: mol_type = other RNA
caggtccagctcgtccagtccggcgccgaggtcaagaagcccggctcctccgtcaaggtctcctgcaaggcctccggcggcaccttccgctcctacgccatctcctgggtccgccaggcccccggccagggcctcgagtggatgggcggcatcatccccatcttcggcaccgccgactacgcccagaagttccagggcaaggtcaccatcaccgccgacgagtccacctccaccgcctacatggagctctcctccctcacctccgaggacaccgccatgtactactgcgcccgctcccgcgaccacttcttcgacacccgcgtcttccagggctggggccagggcaccctcgtcaccgtctcctcc

SEQ ID NO: 16661 - RNA, 363 nt, synthetic construct
  misc_feature 1..363: note = derived and/or modified sequence opt2 from anti-HIV_V2_HeavyChain
  source 1..363: mol_type = other RNA
caggtccagctcgtccagtccggcgccgaggtcaagaagcccggctcctccgtcaaggtctcctgcaaggcctccggcggcaacttcaacacctacaccatctcctgggtccgccaggcccccggccagggcctcgagtggatgggccgcatcatccccatcttcggcatcgtcaaccccgcccagaagttccccggccgcgtcaccatcaacgtcgacaagtccaccaacaccgcctacatggagctctcctccctccgctccgaggacaccgccgtctactactgcgccacctccggcgtcggcctccacttcggctacttcgactactggggccagggcacccaggtcaccgtctcctcc

SEQ ID NO: 16662 - RNA, 378 nt, synthetic construct
  misc_feature 1..378: note = derived and/or modified sequence opt2 from anti-HIV_V2_HeavyChain
  source 1..378: mol_type = other RNA
caggtccagctccagcagtggggccccggcctcctcaagccctccgagaccctctccctcacctgcgccgtctacggcggctccttcggccgctactactggtcctggatccgccagtcctccggcgagggcctcgagtggctcggccagatcgaccacaccggctccaccacctacaacccctccctcaagggccgcgtcaccatctccatcgactcctccaccaaccagttctccctcaaggtcacctccgtcatcgccgccgacaccgccgtctactactgcgcccgcgccccctccggctaccccggcgtctccctctaccagtactacggcctcgacgtctggggccagggcaccaccgtcaccgtctccccc

SEQ ID NO: 16663 - RNA, 366 nt, synthetic construct
  misc_feature 1..366: note = derived and/or modified sequence opt2 from anti-HIV_V2_HeavyChain
  source 1..366: mol_type = other RNA
caggtccagctcgtccagtccggcgccgaggtcaagaagcccggctcctccgtcaaggtctcctgcaaggcctccggcggcaccttctccaactacgccatctcctgggtccgccaggcccccggccagggcctcgagtggatgggcggcatcatccccatcttcggcaccaccgactacgcccagaagttccagggccgcgtcaccatcaccgccgacgcctccacctccaccgcctacatggagctctcctccctccgctccgacgacaccgccgtctactactgcgcccgctcccgcggccactacttcgacacccgcgtcttcgagggctggggccagggcaccctcgtcaccgtctcctcc

SEQ ID NO: 16664 - RNA, 372 nt, synthetic construct
  misc_feature 1..372: note = derived and/or modified sequence opt2 from anti-HIV_V2_HeavyChain
  source 1..372: mol_type = other RNA
caggtccacctcgtccagtccggcaccgaggtcaagaagcccggcgcctccgtcaccgtctcctgcaaggcctccggctactccttcaccggctactacctccactgggtccgccaggcccccggccagggcctcgagtggatgggctggatcaaccccaactccggcggcacctactacgcccagaacttccaggcccgcgtcaccatgacccgcgacacctccatctccaccgtctacatggacctctcccgcctccgctccgacgacaccgccgtctactactgcgtccgccgcgccgtcctcaccgccctccccccccgctactacttcgacttctggggccagggcaccctcgtcaccgtctcctcc

SEQ ID NO: 16665 - RNA, 318 nt, synthetic construct
  misc_feature 1..318: note = derived and/or modified sequence opt2 from anti-HIV_V3_LightChain
  source 1..318: mol_type = other RNA
tccctcgagctcacccagcccccctccgtctccgtctcccccggccagaccgtctccatcacctgctccggcaacctcctcggcgacaaggacgcctcctggtaccagctcaagcccggccagtcccccatcctcgtcatctacctcgacaccgagcgcccctccggcatccccgagcgcttctccggctccaagtccggcaacaccgccaccctcaccatctccggcacccaggccatggacgaggccgagtacttctgccaggcctgggacaccaccaccgtcctcttcggcggcggcacccgcctcaccgtcctc

SEQ ID NO: 16666 - RNA, 324 nt, synthetic construct
  misc_feature 1..324: note = derived and/or modified sequence opt2 from anti-HIV_V3_LightChain
  source 1..324: mol_type = other RNA
tccgacgagctcacccagcccccctccgtctccgtctcccccggccagaccgcccgcatcacctgctccggcgacgccctccccgagaagtacgcctactggtaccagcagaagtccggccaggcccccgtcctcgtcatcgacgaggacaacaagcgccccttcggcacccccgagcgcttctccggctcccgctccggcaccatggccaccctcaccatcaccggcgcccagatggaggacgaggccgactactactgctcctccaccgactcccgcggcacctactgggtcttcggcggcggcaccaagctcaccgtcctc

SEQ ID NO: 16667 - RNA, 336 nt, synthetic construct
  misc_feature 1..336: note = derived and/or modified sequence opt2 from anti-HIV_V3_LightChain
  source 1..336: mol_type = other RNA
cagtccgtcctcacccagcccccctccgtctccgccgcccccggccagaaggtcaccatctcctgctccgccggcaactccaagatcggcgacaactacatctcctggtaccagcacgtccccggcgccgcccccaagctcctcatctacgagaacgacaagcgcccctccggcatccccgaccgcttctccggctccaagtccggcacctccgcctccctcggcatcaccggcctccagaccggcgacgaggccgactactactgcgccgcctgggacaactccctctcctccgccctctacgtcttcggcaccggcaccaaggtcaccgtcctc

SEQ ID NO: 16668 - RNA, 339 nt, synthetic construct
  misc_feature 1..339: note = derived and/or modified sequence opt2 from anti-HIV_V3_LightChain
  source 1..339: mol_type = other RNA
gacatcgtcatgacccagtcccccgactccctcgccgtctccctcggcgagcgcgccaccatcaactgcaagtcctcccagaacgtcttctactcctccaacaaccgcaactacctcgcctggtaccagcagcgccccggccagccccccaagctcctcttctactgggcctccacccgcgagtccggcgtccccgaccgcttctccggctccggctccggcaccgacttcaccctcaccatctcctccctccagaccgaggacgtcgccatctactactgccagcagtactacaacaccccccccaccttcggccccggcaccaaggtcgagatcaag

SEQ ID NO: 16669 - RNA, 318 nt, synthetic construct
  misc_feature 1..318: note = derived and/or modified sequence opt2 from anti-HIV_V3_LightChain
  source 1..318: mol_type = other RNA
tcctacgagctcacccagcccccctccgtctccgtctcccccggccagaccgccaccatcacctgctccggcgacctcctcggcgacaagtacgcctcctggtaccgccagaagcccggccagtcccccgtcctcgtcatctacgaggacaccaagcgcccctccggcctccccgagcgcttctccggctccaactccggcaacaccgccaccctcaccatctccgagacccaggccatggacgaggccgactactactgccaggcctgggacacccgcaccgtcgtcttcggcggcggcaccaagctcaccgtcctc

SEQ ID NO: 16670 - RNA, 327 nt, synthetic construct
  misc_feature 1..327: note = derived and/or modified sequence opt2 from anti-HIV_V3_LightChain
  source 1..327: mol_type = other RNA
cagtccgtcctcacccagcccccctccgtctccgccgcccccggccagaaggtcaccatctcctgctccggccgctcctccgacatcgagaacaagttcgtctcctggtaccagcagctccccggcaccgcccccaagctcctcatctacgaggacaacaagcgcccctccggcatccccgaccgcttctccggctccaagtccggcacctccgccaccctcggcatcaccggcctccagaccggcgacgaggccgactactactgcggcacctgggacaacaacctccgcgccggcttcggcggcggcacccacctcaccgtcctc

SEQ ID NO: 16671 - RNA, 324 nt, synthetic construct
  misc_feature 1..324: note = derived and/or modified sequence opt2 from anti-HIV_V3_LightChain
  source 1..324: mol_type = other RNA
tcctacgagctcacccagcccccctccgtctccgtctcccccggccagaccgcccgcatcacctgctccggcgacgccctccccaacaagtacgccttctggtaccagcagaagtccggccaggcccccgtcctcgtcatcttcgacgacaaccgccgccccgccggcatccccgagcgcttctccggctcccgctccggcaccctcgccaccctcaccatctccggcgcccaggtcgaggacgaggccgactactactgctactccaccgacaacgacggcaagtacttcgtcttcggctccggcaccatggtcaccgtcctc

SEQ ID NO: 16672 - RNA, 318 nt, synthetic construct
  misc_feature 1..318: note = derived and/or modified sequence opt2 from anti-HIV_V3_LightChain
  source 1..318: mol_type = other RNA
tcctacgagctcacccagcccccctccgtctccgtctcccccggccagaccgcctccatcacctgctccggccacaagctcggcgacaagtacgcctcctggtaccagcacaagcccggccagtcccccgtcctcgtcatctacgaggacacccagcgcccctccggcatccccgagcgcatctccggctccaagtccggcaacaccgccaccctcaccatctccggcacccaggccatggacgaggccgactactactgccaggcctgggactcccgcgccgccgtcttcggcggcggcacccgcctcaccgtcctc

SEQ ID NO: 16673 - RNA, 327 nt, synthetic construct
  misc_feature 1..327: note = derived and/or modified sequence opt2 from anti-HIV_V3_LightChain
  source 1..327: mol_type = other RNA
cagtccgccctcacccagcccgcctccgtctccggctcccccggccagtccatcaccatctcctgcaccggcatctcctccgacatcggcaccgacaactacgtctcctggtaccagcagcaccccggcaaggcccccaagctcatcatctacgaggtctccaaccgcccctccggcatctcccaccgcttctccggctccaagtccggcaacaccgcctccctcatcatctccggcctccaggtcgaggacgaggcccactactactgcaactcctaccgctccgacaccctcgtcttcggcggcggcaccaaggtcaccgtcctc

SEQ ID NO: 16674 - RNA, 333 nt, synthetic construct
  misc_feature 1..333: note = derived and/or modified sequence opt2 from anti-HIV_V3_LightChain
  source 1..333: mol_type = other RNA
cagtccgtcctcacccagcccccctccgcctccggcacccccggccagcgcgtcaccatctcctgctccggctcctcctccaacatcggctccaacaccgtcaactggtaccagcacctccccggcaccgcccccaagctcctcatctactccaacgaccagcgcccctccggcgtccccgaccgcttctccggctcctcctccggcacctccgcctccctcgccatctccggcctccagtccgaggacgaggccgactactactgcgccgcctgggacgactccctcaacggccccttcgtcttcggcaccggcaccaaggtcaccgtcctc

SEQ ID NO: 16675 - RNA, 318 nt, synthetic construct
  misc_feature 1..318: note = derived and/or modified sequence opt2 from anti-HIV_V3_LightChain
  source 1..318: mol_type = other RNA
gacatccagatgacccagtccccctcctccctctccgcctccgtcggcgaccgcatcaccatcacctgccgcacctcccagtccatcgacaaccacctcaactggtaccagcacaagcccggcaaggcccccaagctcctcatctccgccgcctcccgcctccagtccggcgtcccctcccgcttcaccggctccggctccggcaccgagttcaccctcaccatctcctccctccagcccgaggacttcgccgtctactactgccagcagtcctacatcaccatcaccttcggccccggcaccaaggtcgacatcaag

SEQ ID NO: 16676 - RNA, 321 nt, synthetic construct
  misc_feature 1..321: note = derived and/or modified sequence opt2 from anti-HIV_V3_LightChain
  source 1..321: mol_type = other RNA
gagatcgtcatgacccagtcccccgccaccctctccgtctcccccggcgagggcgtcaccctctcctgccgcgcctcccagtccgtctcctccaacatcctctggtaccagcagcgccccggccaggccccccgcctcctcctctacggcgcctccacccgcgccaccggcatccccgcccgcttctccggctccggctccggcaccgagttcaccctcaccatcaactccatgcagtccgaggacttcgccatctactactgccagcagtaccacgactggctctggaccctcggccagggcacccaggtcgagatcaag

SEQ ID NO: 16677 - RNA, 327 nt, synthetic construct
  misc_feature 1..327: note = derived and/or modified sequence opt2 from anti-HIV_V3_LightChain
  source 1..327: mol_type = other RNA
tcctacgagctcacccagcccccctccgtctccgtctcccccggccagaccgcctccatcacctgctccggcgacaagatgggcgagcgctacacctcctggtaccagcagaagcccggccagtcccccgtcctcgtcatgtccgagaacatcaagcgccccgccggcatccccgagcgcttctccggctcctcctccggcaacaccgccatcctcaccatctccggcacccaggccgtcgacgaggccgactactactgccaggtctgggacaccaccaccacctcctacgtcatcttcggcggcggcaccaagctcaccgtcctc

SEQ ID NO: 16678 - RNA, 321 nt, synthetic construct
  misc_feature 1..321: note = derived and/or modified sequence opt2 from anti-HIV_V3_LightChain
  source 1..321: mol_type = other RNA
gacatccagatgacccagtccccctcctccctctccgcctccgtcggcgaccgcgtcaccatcacctgccaggcctcccaggacatcggcaactacctcaactggtaccaccagaagcccggcaaggcccccaagctcctcatctacgacgcctccaacgtcgagaccggcgtcgcctcccgcttctccggctccggctccggcaccgacttcaccctcaccatctcctccctccagcccgaggacatcggcacctacttctgccagcagtacgagtccctcccctgggccttcggcggcggcaccaaggtcgagatccgc

SEQ ID NO: 16679 - RNA, 333 nt, synthetic construct
  misc_feature 1..333: note = derived and/or modified sequence opt2 from anti-HIV_V3_LightChain
  source 1..333: mol_type = other RNA
aacttcaagctcacccagccccactccgtctccgagtcccccggcaagaccgtcaccatctcctgcacccgcacctccggcaccatcgccaccaactacgtccagtggttccagcagcgccccggctcctcccccaccaccatgatctacgagaacgacaagcgcccctccggcgtccccgaccgcttctccggctccatcgacacctcctccaactccgcctccctcaccatctccggcctcaagaccgaggacgaggccgactactactgccagtcctacaactccaccgacatcgtcgtcttcggcggcggcaccaagctcaccgtcctc

SEQ ID NO: 16680 - RNA, 327 nt, synthetic construct
  misc_feature 1..327: note = derived and/or modified sequence opt2 from anti-HIV_V3_LightChain
  source 1..327: mol_type = other RNA
cagtccgtcctcacccagcccccctccgtctccgccgcccccggccagaaggtcaccatctcctgctccggctcctcctccaacatcggcaacaacatggtctcctggtaccagcagcaccccggcaccgcccccaagctcctcatctacgagaactccaagcgcccctccggcatccccgaccgcttctccggctcccgctccggcacctccgccaccctcggcatcatcggcctccagaccggcgacgaggccgagtactactgcgccacctgggacggctccctccgcaccgtcttcggcggcggcaccaagctcaccgtcctc

SEQ ID NO: 16681 - RNA, 324 nt, synthetic construct
  misc_feature 1..324: note = derived and/or modified sequence opt2 from anti-HIV_V3_LightChain
  source 1..324: mol_type = other RNA
tcctacgagctcacccagcccccctccgtctccgtctcccccggccagaccgcccgcatcacctgctccggcgacgccctccccaaccagtacggctactggtaccagcagaagcccggccaggcccccgtcctcgtcatcttcaaggactccgagcgcccctccggcatccccgagcgcttctccggctcctcctccggcaccaccgtcaccctcaccatctccggcgtccaggccgaggacgaggccgactactactgccagtccgccgactcctccggcaactacgaggtcttcggcggcggcaccaagctcaccgtcctc

SEQ ID NO: 16682 - RNA, 330 nt, synthetic construct
  misc_feature 1..330: note = derived and/or modified sequence opt2 from anti-HIV_V3_LightChain
  source 1..330: mol_type = other RNA
cagtccgtcctcacccagcccccctccgtctccgaggccccccgccagcgcgtcaccatctcctgctccggctcctcctccaacatcggcaacaacgccgtcaactggtaccagcaggtccccggcaaggcccccaagctcctcatctactacgacgacctcctcccctccggcgtctccgaccgcttctccggctccaagtccggctcctccgcctccctcgccatctccggcctccagtccgaggacgaggccgactactactgcgccgcctgggacgactccctcaaggtctacgtcttcggcaccggcacctccgtcaccgtcctc

SEQ ID NO: 16683 - RNA, 333 nt, synthetic construct
  misc_feature 1..333: note = derived and/or modified sequence opt2 from anti-HIV_V3_LightChain
  source 1..333: mol_type = other RNA
gacatcgtcatgaaccagtcccccccctccctcgccgtcacccccggcgagcccgcctccatctcctgccgcgcctcccagtccctcctctactccgacggccacaactacctcgactggtacctccagaagcccggccaggccccccagctcctcatctacctcggctccacccgcgcctccggcgtccccgaccgcttctccggctccggctccggcaccgacttcaccctcaagatctcccgcgtcgaggccgaggacgtcggcgtctactactgcatgcagcccctccagtcctacaccttcggccagggcaccaagctcgagatcaag

SEQ ID NO: 16684 - RNA, 321 nt, synthetic construct
  misc_feature 1..321: note = derived and/or modified sequence opt2 from anti-HIV_V3_LightChain
  source 1..321: mol_type = other RNA
gcctacgagctcacccagcccccctccgtctccgtctcccccggccagaccgcccgcatcacctgctccggcgacgccctccccaaccagtacgcctactggtaccaccagcgccccggccaggcccccgtcctcgtcatccacaaggacaccgagcgcccctccggcatccccgcccgcttctccggctcctcctccggcaccaccgtcaccctcaccatctccgaggtccaggccgaggacgagggcgactactactgccagtccgccgacacctccgcctacgtcgtcttcggcggcggcaccaagctcaccgtcctc

SEQ ID NO: 16685 - RNA, 330 nt, synthetic construct
  misc_feature 1..330: note = derived and/or modified sequence opt2 from anti-HIV_V3_LightChain
  source 1..330: mol_type = other RNA
cagtccgtcctcacccaggccccctcctcctccggcacccccggccagtccgtcaccatctcctgctccggctcctcctccaacatggagatcaactacgtctactggtaccgccagttccccggcaccgccccccagctcctcatctacaacgacaaccagcgcccctccggcgtccccgaccgcttctccgcctccaagtccggcacctccgcctccctcgccatcggcggcctccgctccgaggacgaggccgactacttctgcgccgtctggcacggcgaccgcggcggccccgtcttcggcggcggcaccaagctcaccgtcctc

SEQ ID NO: 16686 - RNA, 327 nt, synthetic construct
  misc_feature 1..327: note = derived and/or modified sequence opt2 from anti-HIV_V3_LightChain
  source 1..327: mol_type = other RNA
tcctacgagctcaagcagccccgctccgtctccgtctcccccggccagaccgcccgcatcacctgctccggcgacgccatgcccaaccagtacgcctactggtaccagcagcgccccggccgcgcccccgtcctcctcatcttcaaggacaacgagcgcgcctccggcatccccgagcgcatctccggctcctcctccggcaccaccgccaccctcaccatcaaccgcgtccaggccgaggacgaggccgactacctctgccagtccgccgactcctccggcgccttcccctgggtcttcggcggcggcaccaccctcaccgtcctc

SEQ ID NO: 16687 - RNA, 324 nt, synthetic construct
  misc_feature 1..324: note = derived and/or modified sequence opt2 from anti-HIV_V3_LightChain
  source 1..324: mol_type = other RNA
tcctacgagctcacccagcccccctccgtctccgtctcccccggccagaccgcccgcatcacctgctccggcgacgccctccccaaggagtacgcctactggtaccagcagaagtccggccaggcccccgtcctcgtcatctacgaggacacccgccgcccctccggcatccccgagcgcttctccggctcctcctccggcaccatggccaccctcaccgtctccggcgcccacgtcgacgacgaggccgactactactgctactcccgcgacacctccgccaaccagtgggtcttcggcggcggcaccaagctcaccgtcctc

SEQ ID NO: 16688 - RNA, 318 nt, synthetic construct
  misc_feature 1..318: note = derived and/or modified sequence opt2 from anti-HIV_V3_LightChain
  source 1..318: mol_type = other RNA
gagatcgtcctcacccagtcccccgccaccctctccctctcccccggcgagcgcgccaccctctcctgccgcgcctcccagtccatctccacctacctcggctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctacacctggatcaccttcggccagggcacccgcctcgagatcaag

SEQ ID NO: 16689 - RNA, 327 nt, synthetic construct
  misc_feature 1..327: note = derived and/or modified sequence opt2 from anti-HIV_V3_LightChain
  source 1..327: mol_type = other RNA
tcctacgagctcacccagcccccctccgtctccgtctcccccggccagaccgcccgcatcacctgctccggcgacgccctccccaaccagtacgtctactggtaccagcagcgccccggccaggcccccgtcgtcgtcctctacaaggacaccgagcgcccctccggcatccccgagcgcttctccggctcctcctccggcaccaccgtcaccctcaccatctccggcgtccaggccgaggacgaggccgactactactgccagtccgccgacaactccggcgcctaccccctcttcttcggcggcggcaccaagctcaccgtcctc

SEQ ID NO: 16690 - RNA, 333 nt, synthetic construct
  misc_feature 1..333: note = derived and/or modified sequence opt2 from anti-HIV_V3_LightChain
  source 1..333: mol_type = other RNA
cagtccgtcctcacccagcccccctccgtctccgccgcccccggccagaaggtcaccatctcctgctccggctcctcctccaacatcggcaacaactacgtcctctggtaccagcagttccccggcaccgcccccaagctcctcatctacggcaacaacaagcgcccctccggcatccccgaccgcttctccggctccaagtccggcacctccgccaccctcggcatcaccggcctccagaccggcgacgaggccgactacttctgcgccacctgggactccggcctctccgccgactgggtcttcggcggcggcaccaagctcaccgtcctc

SEQ ID NO: 16691 - RNA, 321 nt, synthetic construct
  misc_feature 1..321: note = derived and/or modified sequence opt2 from anti-HIV_V3_LightChain
  source 1..321: mol_type = other RNA
gacatccagatgacccagtccccctcctccctctccgcctccgtcggcgaccgcgtcaccatcacctgccgcgcctcccaggagatcgacaactacctcgcctggtaccagcagcgccccggcaaggcccccaagtccctcatctacgccgcctcctccctccagggcggcgtcccccccaagttctccggctccggctccggcaccgagttcaccctcaccatctcctccctccaggccgaggacttcgccacctactactgccagcagtacaacgcctaccccctcaccttcggccagggcacccgcctcgacatcaac

SEQ ID NO: 16692 - RNA, 324 nt, synthetic construct
  misc_feature 1..324: note = derived and/or modified sequence opt2 from anti-HIV_V3_LightChain
  source 1..324: mol_type = other RNA
tcctacgagctcacccagcccccctccctctccgtctcccccggccagaccgcctccatcacctgctccggcgacggcctccccaagcagtacggctactggtaccagcagaagcccggccaggcccccctcctcgtcatcctcaaggacaccgagcgcccctccggcatccccgagcgcttctccggctcctcctccggcaccaccgtcaccctcaccatctccggcgtccaggccgaggacgaggccgactactactgccagtccgtcgactccaccggctcctactacgtcttcggccccggcaccaaggtcaccgtcctc

SEQ ID NO: 16693 - RNA, 324 nt, synthetic construct
  misc_feature 1..324: note = derived and/or modified sequence opt2 from anti-HIV_V3_LightChain
  source 1..324: mol_type = other RNA
tcctacgagctcacccagcccccctccgtctccgtctcccccggccagaccgcccgcatcacctgctccggcgacgtcctccccaagaagtacgcctactggtaccagcagaagtccggcctcgcccccgtcctcgtcatctacgaggacaaccgccgcccctccggcatccccgagcgcttctccggctcctcctccggcaccatggccaccctcaccatctccggcgcccaggtcgaggacgagggcgactactactgctcctccaccgactcctccggcgaccactacgtcttcggcaccggcaccaaggtcaccgtcctc

SEQ ID NO: 16694 - RNA, 321 nt, synthetic construct
  misc_feature 1..321: note = derived and/or modified sequence opt2 from anti-HIV_V3_LightChain
  source 1..321: mol_type = other RNA
gcctacgagctcacccagcccccctccgtctccgtctcccccggccagaccgcccgcatcacctgctccgccgaggccctctccaaccagtacgcctactggtaccgccagcgccccggccaggcccccctcctcatcatctacaaggacaccaagcgcccctccggcatccccgagcgcttctccggctccacctccggcaccaccgtcaccctcaccatctccggcgtccaggccgaggacgaggccgactactactgccagtccgccgactcctccggcgactacgtcttcggcggcggcaccaaggtcaccgtcctc

SEQ ID NO: 16695 - RNA, 333 nt, synthetic construct
  misc_feature 1..333: note = derived and/or modified sequence opt2 from anti-HIV_CD4bs_LightChain
  source 1..333: mol_type = other RNA
cagcccgtcctcacccagtcctcctccgcctccgcctccctcggctcctccgtcaagctcacctgcaccctcggctccggccactccggctccatcatcgcctggcaccagcagcagcccggcaaggccccccgctacctcatgaaggtccagtcctccggctcctacaacaagggctccggcgtccccgaccgcttctccggctcctcctccggcgccgaccgctacctcaccatctccaacctccagttcgaggacgagggcgactactactgcgagacctgggacaccaacaagtacgtcttcggcaccggcaccaaggtcaccgtcctc

SEQ ID NO: 16696 - RNA, 324 nt, synthetic construct
  misc_feature 1..324: note = derived and/or modified sequence opt2 from anti-HIV_CD4bs_LightChain
  source 1..324: mol_type = other RNA
gagctcgtcctcacccagtcccccggcaccctctccctctcccccggcgagcgcgccaccctctcctgccgcgcctcccagtccgtcgcctcctactacctcgcctggtaccagcagaagcccggccaggccccccgcctcctcatctacggcgcctcctcccgcgccaccggcatccccgaccgcttctccggctccgtctccggcaccgacttcaccctcaccatctcccgcctcgagcccgaggacttcgccctctactactgccagcagtacggctcctcccccctctccttcggcggcggcaccaaggtcgagatccgc

SEQ ID NO: 16697 - RNA, 333 nt, synthetic construct
  misc_feature 1..333: note = derived and/or modified sequence opt2 from anti-HIV_CD4bs_LightChain
  source 1..333: mol_type = other RNA
cagtccgccctcacccagcccccctccatgtccggctcccccggccagtccatcaccatctcctgcaccggctccggctccgacgtcggctcccacaacttcgtctcctggtaccagcagcaccccgcccgcgtccccaagctcctcatctacgccgtcggcaaccgcccctccggcgtctccgagcgcttctccggctccaagtccggcaacaccgcctacctcaccatctccggcctccaggccgacgacgaggccgactactactgctcctcccacaccaccggcaccaccctcgaggtcttcggcggcggcacccgcctcaccgtcctc

SEQ ID NO: 16698 - RNA, 333 nt, synthetic construct
  misc_feature 1..333: note = derived and/or modified sequence opt2 from anti-HIV_CD4bs_LightChain
  source 1..333: mol_type = other RNA
gacatcgtcatgacccagtcccccctctccctccccgtcacccccggcgagcccgcctccatctcctgccgctcctccgagtccctcctccactccaacggcttcatctacctcgactggtacctccagaagcccggccagtccccccagctcctcatctacctcggctccaagcgcgcctccggcgtctccgaccgcttctccggctccggctccggcaccgccttcaccctcaagatctcccgcgtcgaggccgaggacgtcggcgtctactactgcatgcaggccctcgagtcccgcaccttcggccagggcaccaagctcgagatcaag

SEQ ID NO: 16699 - RNA, 327 nt, synthetic construct
  misc_feature 1..327: note = derived and/or modified sequence opt2 from anti-HIV_CD4bs_LightChain
  source 1..327: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccagtccccccgcctcctcatctacggcgcctcctcccgcgccaccggcatccccgaccgcttctccggctccggctccggcaccgacttcaccctcaccatctcccgcctcgagcccgaggacttcgccgtctactactgccagcactacggctcctcctccatcttcaccttcggccccggcaccaaggtcgacatccgc

SEQ ID NO: 16700 - RNA, 330 nt, synthetic construct
  misc_feature 1..330: note = derived and/or modified sequence opt2 from anti-HIV_CD4bs_LightChain
  source 1..330: mol_type = other RNA
aacttcatgctcacccagccccactccgtctccggctcccccggcaagaccgtcaccatctcctgcacccgctcctccggctccatcgccggcaactacgtccagtggtaccagcagcgccccggcacctcccccaccaccgtcatctacgagaacgaccagcgctcctccggcgtccccgaccgcttctccggctccatcgactcctcctccaactccgcctccctcaccatctccggcctcaagaccgaggacgaggccgactactactgccactcctacgacgccaccaaccaggtcttcggcggcggcaccaagctcaccgtcctc

SEQ ID NO: 16701 - RNA, 333 nt, synthetic construct
  misc_feature 1..333: note = derived and/or modified sequence opt2 from anti-HIV_CD4bs_LightChain
  source 1..333: mol_type = other RNA
gacgtcgtcgtcacccagtcccccctctccctccccgtcaccctcggccagcccgcctccatctcctgccgctcctcccagtccctcgtctactccgacggcaccacccacctcaactggtaccaccagcgccccggccagcccccccgccgcctcatctaccgcgtctccaaccgcgactccggcgtccccgaccgcttctccggctccggctccggcaccgacttcaccctccgcatctcccgcgtcgaggccgaggacgtcggcctctactactgcatgctcgccacccaccccttcaccttcggccccggcaccaaggtcgagatcaag

SEQ ID NO: 16702 - RNA, 336 nt, synthetic construct
  misc_feature 1..336: note = derived and/or modified sequence opt2 from anti-HIV_CD4bs_LightChain
  source 1..336: mol_type = other RNA
cagtccgtcctcacccagcccccctccgtctccggcgcccccggccagaccgtcaccatctcctgcaccggctcctcctccaacatcggcccctcctacgacgtccagtggtaccagcagttccccggccgcgcccccaagctcctcatctccggcaacaacaaccgcgcctccggcgtccccgaccgcttctccggctccaagtccggcacctccgcctccctcgccatcaccggcctccagtccgaggacgaggccgactactactgccagacctacgactcctccctctccggccacgtcgtcttcggcggcggcacccgcctcaccgtcctc

SEQ ID NO: 16703 - RNA, 321 nt, synthetic construct
  misc_feature 1..321: note = derived and/or modified sequence opt2 from anti-HIV_CD4bs_LightChain
  source 1..321: mol_type = other RNA
gacatccagatgacccagtccccctccaccctctccgcctccgtcggcgaccgcgtcaccatcacctgccgcgcctccgcctccatctacacctggctcgcctggtaccagcagcgccccggcaaggcccccgaggtcctcatctacaaggcctccaccctcaagtccggcgtcccctcccgcttctccggctccggctccggcaccgagttcaccctcaccatctcctccctccagcccggcgacttcgccacctactactgccagcagtacaccacctaccccctcaccttcggcggcggcaccaccgtcgagatcaag

SEQ ID NO: 16704 - RNA, 330 nt, synthetic construct
  misc_feature 1..330: note = derived and/or modified sequence opt2 from anti-HIV_CD4bs_LightChain
  source 1..330: mol_type = other RNA
cagtccgccctcacccagcccgcctccgtctccggctcccccggccagtccatcaccatctcctgcaccggcacctccaacgacatcggcacctacaacctcgtctcctggtaccagcaccaccccaacaaggcccccaaggtcgtcgtctacgagaacaacaagcgcccctccggcatctccaaccgcttctccggctccaagtccggcaacaccgcctccctcaccatctccggcctccaggccgaggacgaggccgactactactgctgctcctacgccggctcctccacctgggtcttcggcggcggcaccaagctcaccgtcctc

SEQ ID NO: 16705 - RNA, 321 nt, synthetic construct
  misc_feature 1..321: note = derived and/or modified sequence opt2 from anti-HIV_V2_LightChain
  source 1..321: mol_type = other RNA
gacatccagatgacccagtccccctccaccctctccgcctccgtcggcgaccgcgtcaccatcacctgccgcgcctcccagaccatctcctcctggctcgcctggtaccagcagaagtccggcaccgcccccaagctcctcatctacaaggcctcctccatcgtctccggcgtcccctcccgcttctccggctccggctccggcaccgagttcaccctcaccatcacctccctccagcccgacgacttcgccacctactactgccagcagtacaactcctcccccgagaccttcggccagggcaccaaggtcgagatcaag

SEQ ID NO: 16706 - RNA, 318 nt, synthetic construct
  misc_feature 1..318: note = derived and/or modified sequence opt2 from anti-HIV_V2_LightChain
  source 1..318: mol_type = other RNA
gagatcgtcctcacccagtcccccggcaccctctccctctcccccggcgagcgcgccaccctctcctgccgcgcctcccagtccgtctcctcctacctcgcctggtaccagcagaagcccggccaggccccccgcctcctcatctacgacgcctcctcccgcgccaccggcatccccgaccgcttctccggctccggctccggcaccgacttcaccctcaccatctcccgcctcgagcccgaggacttcgccgtctactactgccagcactacgccggctcccgcaccttcggccagggcaccaaggtcgagatcaag

SEQ ID NO: 16707 - RNA, 333 nt, synthetic construct
  misc_feature 1..333: note = derived and/or modified sequence opt2 from anti-HIV_V2_LightChain
  source 1..333: mol_type = other RNA
cagtccgtcctcacccagcccccctccgtctccggcgcccccggccagcgcgtcaccatctcctgcaccggctcctcctccaacatcggcgcccactacgacgtccactggtaccagcagctccccggcaccgcccccaagctcctcatctacggcaactccaaccgcccctccggcgtccccgaccgcttctccggctccaagtccggcacctccgcctccctcgccatcaccggcctccaggccgaggacgaggccgactactactgccagtcctacgactcctccctctccggctacgtcttcggcaccggcaccaaggtcaccgtcctc

SEQ ID NO: 16708 - RNA, 324 nt, synthetic construct
  misc_feature 1..324: note = derived and/or modified sequence opt2 from anti-HIV_V2_LightChain
  source 1..324: mol_type = other RNA
gacaccgtcatgacccagtcccccgccaccctctccgtctcccccggcgagcgcgtcaccctctcctgccgcgcctcccagatcatcaacaccaacctcgcctggtaccagaagcgccccggccaggccccccgcctcctcatctacgccgcctccgcccgcgccaccggcatccccgcccgcttctccggctccggctccggcaccgagttcaccctcaccatctccggcctccagtccgaggactccgccgtctactactgccagcagtacaagcactggcccccctacaccttcggccgcggcaccaagctcgagatccgc

SEQ ID NO: 16709 - RNA, 321 nt, synthetic construct
  misc_feature 1..321: note = derived and/or modified sequence opt2 from anti-HIV_V2_LightChain
  source 1..321: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctcccgcaccttcggccagggcaccaaggtcgagatcaag

SEQ ID NO: 16710 - RNA, 321 nt, synthetic construct
  misc_feature 1..321: note = derived and/or modified sequence opt2 from anti-HIV_V2_LightChain
  source 1..321: mol_type = other RNA
gacatccagatgacccagtccccctcctccctctccgcctccgtcggcgaccgcgtcaccatcacctgccgcgcctcccagtccatctccggcaacctcaactggtaccagcagaagcccggcaaggcccccaacctcctcatctacggcgcctcctccctccagtccggcgtcccctcccgcttctccggctccggctccggcaccgacttcaccctcaccatctcctccctccagcccgaggacttcgccacctaccactgccagcagtcccactccacctcctggaccttcggccagggcaccaaggtcgtcatcaag

SEQ ID NO: 16711 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaaccactacacctcctggtaccagcagaagaccggccaggcccccgtcctcctcatctaccccaagcacaaccgctcccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccgaggtcaccggcctc

SEQ ID NO: 16712 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaaccactacacctcctggtaccagcagaagaccggccaggcccccgtcctcctcatctaccccaagcacaaccgctcccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccaaggtcaccgtcgtc

SEQ ID NO: 16713 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaactactacacctcctggtaccagcagaagcccggccaggcccccgtcctcctcatctaccccaagcacaaccgcccccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccaaggtcaccggcctc

SEQ ID NO: 16714 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaactactacacctcctggtaccagcagaagcccggccaggcccccgtcctcctcatctaccccaagcacaaccgcccccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggccgcggcaccaagctcaccgtcgtc

SEQ ID NO: 16715 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaaccactacacctcctggtaccagcagaagaccggccaggcccccgtcctcctcatctaccccaagcacaaccgctcccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccaaggtcaccgtcctc

SEQ ID NO: 16716 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaactactacacctcctggtaccagcagaagccccgccaggcccccgtcctcctcatctaccccaagcacaaccgcccccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccaagctcaccgtcctc

SEQ ID NO: 16717 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaactactacacctcctggtaccagcagaagcccggccaggcccccgtcctcctcatctaccccaagcacaaccgcccccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccaagctcaccgtcctc

SEQ ID NO: 16718 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccaccgtctccgtcgccctcggccagaccgtcaccatcacctgccgcggcgactccctccgcaaccactacacctcctggtaccagcagaagaccggccaggcccccatcctcctcatctaccccaagcacaaccgcccccccggcatctccgaccgcttctccgcctcctcctccggcaacaccgcctccctcaccatcaccggcgcccagaccgaggacgagggcgactactactgctcctcccgcgacaagtccggctcccgcctcgtcaccttcggcggcggcaccaagctcaccgtcctc

SEQ ID NO: 16719 - RNA, 327 nt, synthetic construct
  misc_feature 1..327: note = derived and/or modified sequence opt2 from anti-HIV_10E8
  source 1..327: mol_type = other RNA
tcctccgacctcacccaggaccccgccgtctccgtcgccctcggccagaccgtccgcatcacctgccagggcgactccctccgccgctactacgccggctggtaccagcagaagcccggccaggcccccgtcctcgtcgtctacggccgcgacaaccgcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16720 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccgccgtctccgtcgccttcgagaagaccgtcaccatcacctgccagggcgactccctccgctcccactacgtctcctggtaccagaagcgccccggccaggcccccgtcctcgtcttctacggcaagaacaaccgcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcccc

SEQ ID NO: 16721 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccgccgtctccgtcgccctcaagcagaccgtcaccatcacctgccgcggcgactccctccgctcccactacgtctcctggtaccagcagaagcccggccaggcccccgtcctcgtcttctacggcaagaacaaccgcccctccggcatccccgaccgcttctccggctcctcctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16722 - RNA, 327 nt, synthetic construct
  misc_feature 1..327: note = derived and/or modified sequence opt2 from anti-HIV_10E8
  source 1..327: mol_type = other RNA
tcctccgagctcacccaggaccccggcgtctccgtcgccctcaagcagaccgtcaccatcacctgccgcggcgactccctccgctcccactacgtctcctggtaccagaagaagcccggccaggcccccgtcctcgtcttctacggcaagaacatcggcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16723 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccgccgtctccgtcgccctcaagcagaccgtcaccatcacctgccgcggcgactccctccgctcccactacgtctcctggtaccagaagaagcccggccaggcccccgtcctcgtcttctacggcaagaacaaccgcccctccggcatccccgaccgcttctccggctcctcctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16724 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccggcgtctccgtcgccctcaagcagaccgtcaccatcacctgccgcggcgactccctccgctcccactacgtctcctggtaccagaagcgccccggccaggcccccgtcctcgtcttctacggcaagaacaaccgcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16725 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccggcgtctccgtcgccctcgagcagaccgtcaccatcacctgccgcggcgactccctccgctcccactacgtctcctggtaccagaagaagcccggccaggcccccgtcctcgtcttctacggcaagaacaaccgcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16726 - RNA, 327 nt, synthetic construct
  misc_feature 1..327: note = derived and/or modified sequence opt2 from anti-HIV_10E8
  source 1..327: mol_type = other RNA
gcctccgagctcacccaggaccccggcgtctccgtcgccctcaagcagaccgtcaccatcacctgccgcggcgactccctccgctcccactacgtctcctggtaccagaagaagcccggccaggcccccgtcctcgtcttctacggcaagaacaaccgcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16727 - RNA, 327 nt, synthetic construct
  misc_feature 1..327: note = derived and/or modified sequence opt2 from anti-HIV_10E8
  source 1..327: mol_type = other RNA
tcctccgagctcacccaggaccccggcgtctccgtcgccctcaagcagaccgtcaccatcacctgccgcggcgactccctccgctcccactacgtctcctggtaccagaagaagcccggccaggcccccgtcctcgtcttctacggcaagaacaaccgcccctccggcatccccgaccgcttctccggctccacctccggcaacaccgcctccctcaccatcgccggcgcccaggccgaggacgacgccgactactactgctcctcccgcgacaagtccggctcccgcctctccgtcttcggcggcggcaccaagctcaccgtcctc

SEQ ID NO: 16728 - RNA, 327 nt, synthetic construct
  misc_feature 1..327: note = derived and/or modified sequence opt2 from anti-HIV_10E8
  source 1..327: mol_type = other RNA
tcctccgagctcacccaggagaccggcgtctccgtcgccctcggccgcaccgtcaccatcacctgccgcggcgactccctccgctcccactacgcctcctggtaccaggagaagcccggccaggcccccaagctcctcttctacggcaagaacaaccgcccctccggcatccccgaccgcttctccggctccgcctccggcaaccgcgcctccctcaccatctccggcgcccaggccgaggacgacgccgagtactactgctcctcccgcgacaagtccggctcccgcctctccgtcttcggcggcggcaccaagctcgccgtcctc

SEQ ID NO: 16729 - RNA, 327 nt, synthetic construct
  misc_feature 1..327: note = derived and/or modified sequence opt2 from anti-HIV_10E8
  source 1..327: mol_type = other RNA
tcctccgagctcacccaggagaccggcgtctccgtcgccctcggccgcaccgtcaccatcacctgccgcggcgactccctccgctcccactacgcctcctggtaccagaagaagcccggccaggcccccaagctcctcttctacggcaagaacaaccgcccctccggcatccccgaccgcttctccggcttcgcctccggcaaccgcgcctccctcaccatctccggcgcccaggccgaggacgacgccgagtactactgctcctcccgcgacaagtccggctcccgcctctccgtcttcggcggcggcaccaagctcaccgtcctc

SEQ ID NO: 16730 - RNA, 327 nt, synthetic construct
  misc_feature 1..327: note = derived and/or modified sequence opt2 from anti-HIV_10E8
  source 1..327: mol_type = other RNA
tcctccgagctcacccaggagaccggcgtctccgtcgccctcggccgcaccgtcaccatcacctgccgcggcgactccctccgctcccactacgcctcctggtaccagaagaagcccggccaggcccccaagctcctcttctacggcaagaacaaccgcccctccggcatccccgaccgcttctccggctccgcctccggcaaccgcgcctccctcaccatctccggcgcccaggccgaggacgacgccgagtacatctgctcctcccgcgacaagtccggctcccgcctctccgtcttcggcggcggcaccaagctcaccgtcctc

SEQ ID NO: 16731 - RNA, 327 nt, synthetic construct
  misc_feature 1..327: note = derived and/or modified sequence opt2 from anti-HIV_10E8
  source 1..327: mol_type = other RNA
tcctccgagctcacccaggagaccggcgtctccgtcgccctcggccgcaccgtcaccatcacctgccgcggcgactccctccgctcccactacgcctcctggtaccagaagaagcccggccaggcccccaagctcctcttctacggcaagaacaaccgcccctccggcatccccgaccgcttctccggctccgcctccggcaaccgcgcctccctcaccatctccggcgcccaggccgaggacgacgccgagtactactgctcctcccgcgacaagtccggctcccgcctctccgtcttcggcggcggcaccaagctcaccgtcctc

SEQ ID NO: 16732 - RNA, 327 nt, synthetic construct
  misc_feature 1..327: note = derived and/or modified sequence opt2 from anti-HIV_10E8
  source 1..327: mol_type = other RNA
tcctccgagctcacccaggagaccggcgtctccgtcgccctcggccgcaccgtcaccatcacctgccgcggcgactccctccgctcccactacgcctcctggtaccagaagaagcccggccaggcccccatcctcctcttctacggcaagaacaaccgcccctccggcatccacgaccgcttctccggctccgcctccggcaaccgcgcctccctcaccatctccggcgcccaggccgaggacgacgccgagtactactgctcctcccgcgacaagtccggctcccgcctctccgtcttcggcggcggcaccaagctcaccgtcctc

SEQ ID NO: 16733 - RNA, 393 nt, synthetic construct
  misc_feature 1..393: note = derived and/or modified sequence opt2 from anti-HIV_10E8
  source 1..393: mol_type = other RNA
gaggtccagctcgtcgagtccggcggcgacctcgtcaagcccggcggctccctccgcctctcctgctccgcctccggcttctccttcaagaacacctggatgacctgggtccgccaggcccccggcaagggcctcgagtgggtcggccgcatcaccggccccggcgagggctggacctccgactacgccgccaccgtccagggccgcttcaccatctcccgcaacaacatgatcgacatgctctacctcgagatgaaccgcctccgcaccgacgacaccggcctctactactgcgtccacaccgagaagtactacaacttctggggcggctacccccccggcgaggagtacttccagcactggggccgcggcaccctcgtcatcgtctcctcc

SEQ ID NO: 16734 - RNA, 393 nt, synthetic construct
  misc_feature 1..393: note = derived and/or modified sequence opt2 from anti-HIV_10E8
  source 1..393: mol_type = other RNA
gagatccgcctcgtcgagtccggcggcggcctcgtcaagcccggcggctccctccgcctctcctgctccgcctccggcttcaacttcgactccgcctggatgacctgggtccgccagccccccggcaagggcctcgagtgggtcggccgcatcaccggccccggcgagggctggtccgtcggctacgccgagtccgtcaagggccgcttcatcatctcccgcatcaactccatcaacttcctctacctcgagatgaacaacctccgccccgaggacaccggctcctacttctgcgcccacaccggcaagcactacgacttctggcgcggctacccccccggcgaggagtacttccaggactggggccagggcacccaggtcatcgtctcctcc

SEQ ID NO: 16735 - RNA, 393 nt, synthetic construct
  misc_feature 1..393: note = derived and/or modified sequence opt2 from anti-HIV_10E8
  source 1..393: mol_type = other RNA
gagatccgcctcgtcgagtccggcggcggcctcgtcaagcccggcggctccctccgcctctcctgctccgcctccggcttcaacttcgactccgcctggatgacctgggtccgccagccccccggcaagggcctcgagtgggtcggccgcatcaccggccccggcgagggctggtccgtcgactacgccgagtccgtcaagggccgcttcatcatctcccgcatcaactccatcaacttcctctacctcgagatgaacaacctccgccccgaggacaccggctcctacttctgcgcccacaccggcaagcactacgacttctggcgcggctacccccccggcgaggagtacttccaggactggggccagggcacccaggtcatcgtctcctcc

SEQ ID NO: 16736 - RNA, 393 nt, synthetic construct
  misc_feature 1..393: note = derived and/or modified sequence opt2 from anti-HIV_10E8
  source 1..393: mol_type = other RNA
gaggtccgcctcgtcgagtccggcggccgcctcgtccgccccggcggctccctccgcctctcctgctccgcctccggcttcaacttcgacaacgcctggatgacctgggtccgccagccccccggcaagggcctcgagtgggtcggccgcatcaccggccccggcgagggctggtccgtcgactacgccgcctccgtcaagggccgcttcaccatctcccgcatgaactccatcaacttcttctacctcgagatgaacaacctcaagatcgaggacaccggcctctacttctgcgcccgcaccggcaagcactacgccttctggggcggctacccccccggcgaggagtacctcgaggactggggccagggcaccctcgtcatcgtctcctcc

SEQ ID NO: 16737 - RNA, 393 nt, synthetic construct
  misc_feature 1..393: note = derived and/or modified sequence opt2 from anti-HIV_10E8
  source 1..393: mol_type = other RNA
gaggtccgcctcgtcgagtccggcggcggcctcgtcaagcccggcggctccctccgcctctcctgctccgcctccggcttcaacttcgacgacgcctggatgacctgggtccgccagccccccggcaagggcctcgagtgggtcggccgcatctccggccccggcgagggctggtccgtcgactacgccgagtccgtcaagggccgcttcaccatctcccgcctcaactccatcaacttcctctacctcgagatgaacaacgtccgcaccgaggacaccggctactacttctgcgcccgcaccggcaagcactacgacttctggtccggctacccccccggcgaggagtacttccaggactggggccagggcaccctcgtcatcgtctcctcc

SEQ ID NO: 16738 - RNA, 393 nt, synthetic construct
  misc_feature 1..393: note = derived and/or modified sequence opt2 from anti-HIV_10E8
  source 1..393: mol_type = other RNA
gaggtccgcctcgccgagtccggcggcggcctcgtcaagcccggcggctccctccgcctctcctgctccgcctccggcttcgacttcgacaacgcctggatgacctgggtccgccagccccccggcaagggcctcgagtgggtcggccgcatcaccggccccggcgagggctggtccgtcgactacgccgcccccgtcgagggccgcttcaccatctcccgcctcaactccatcaacttcctctacctcgagatgaacaacctccgcatggaggactccggcctctacttctgcgcccgcaccggcaagtactacgacttctggtccggctacccccccggcgaggagtacttccaggactggggccagggcaccctcgtcatcgtcccctcc

SEQ ID NO: 16739 - RNA, 393 nt, synthetic construct
  misc_feature 1..393: note = derived and/or modified sequence opt2 from anti-HIV_10E8
  source 1..393: mol_type = other RNA
gaggtccgcctcgtcgagtccggcggcggcctcgtcaagcccggcggctccctccgcctctcctgctccgcctccggcttcgacttcgacaacgcctggatgacctgggtccgccagccccccggcaagggcctcgagtgggtcggccgcatcaccggccccggcgagggctggtccgtcgactacgccgcccccgtcgagggccgcttcaccatctcccgcctcaactccatcaacttcctctacctcgagatgaacaacctccgcatggaggactccggcctctacttctgcgcccgcaccggcaagtactacgacttctggtccggctacccccccggcgaggagtacttccaggactggggccagggcaccctcgtcatcgtcccctcc

SEQ ID NO: 16740 - RNA, 393 nt, synthetic construct
  misc_feature 1..393: note = derived and/or modified sequence opt2 from anti-HIV_10E8
  source 1..393: mol_type = other RNA
gaggtccgcctcgtcgagtccggcggcggcctcgtcaagcccggcggctccctccgcctctcctgctccgcctccggcttcgacttcgacaacgcctggatgacctgggtccgccagccccccggcaagggcctcgagtgggtcggccgcatcaccggccccggcgagggctggtccgtcgactacgccgcccccgtcgagggccgcttcaccatctcccgcctcaactccatcaacttcctctacctcgagatgaacaacctccgcatggaggactccggcctctacttctgcgcccgcaccggcaagtactacgacttctggtccggctacccccccggcgaggagtacttccaggactggggccagggcaccctcgtcatcgtctcctcc

SEQ ID NO: 16741 - RNA, 393 nt, synthetic construct
  misc_feature 1..393: note = derived and/or modified sequence opt2 from anti-HIV_10E8
  source 1..393: mol_type = other RNA
gaggtccgcctcgccgagtccggcggcggcctcgtcaagcccggcggctccctccgcctctcctgctccgcctccggcttcgacttcgacaacgcctggatgacctgggtccgccagccccccggcaagggcctcgagtgggtcggccgcatcaccggccccggcgagggctggtccgtcgactacgccgcccccgtcgagggccgcttcaccatctcccgcctcaactccatcaacttcctctacctcgagatgaacaacctccgcatggaggactccggcctctacttctgcgcccgcaccggcaagtactacgacttctggtccggctacccccccggcgaggagtacttccaggactggggccgcggcaccctcgtcatcgtctcctcc

SEQ ID NO: 16742 - RNA, 393 nt, synthetic construct
  misc_feature 1..393: note = derived and/or modified sequence opt2 from anti-HIV_10E8
  source 1..393: mol_type = other RNA
gaggtccgcctcgtcgagtccggcggcggcctcgtcaagcccggcggctccctccgcctctcctgctccgcctccggcttcgacttcgacaacgcctggatgacctgggtccgccagccccccggcaagggcctcgagtgggtcggccgcatcaccggccccggcgagggctggtccgtcgactacgccgcccccgtcgagggccgcttcaccatctcccgcctcaactccatcaacttcctctacctcgagatgaacaacctccgcatggaggactccggcctctacttctgcgcccgcaccggcaagtactacgacttctggtccggctacccccccggcgaggagtacttccaggactggggccgcggcaccctcgtcatcgtctcctcc

SEQ ID NO: 16743 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggccgctcctccaacatcggcaacaacaacgtcttctggtaccagcagctccccggcaccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16744 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccgcctccgtctccggctcccccggccagtccatcaccatctcctgcaccggcaccaagtccgacatcggcggctacaagtacgtctcctggtaccagcagcaccccggcaaggcccccaagatcctcatctacgacgtcaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16745 - RNA, 321 nt, synthetic construct
  misc_feature 1..321: note = derived and/or modified sequence opt2 from anti-HIV-1_LightChain
  source 1..321: mol_type = other RNA
cagtccgtcctcacccagcccccctccgtctccgccgcccccggccagcgcgtcaccatctcctgcttcggctcccgcttctcctccgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16746 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagaccatcaccatctcctgctccggctcctcctccaacatcggctccaacgacgtctactggtaccagcacctccccggcaccacccccaaggtcgtcatctacaagaacaaccgccgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16747 - RNA, 327 nt, synthetic construct
  misc_feature 1..327: note = derived and/or modified sequence opt2 from anti-HIV-1_LightChain
  source 1..327: mol_type = other RNA
cagtccgtcctcacccagcccccctccatgtccgccgcccccggccagaaggtcaccatctcctgctccggctccacctccatcatcggcaacaactacatctcctggtaccagcagctccccggcaccgcccccaagctcctcatctacgaggacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcacc

SEQ ID NO: 16748 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggcctcaaggtcaccatctcctgctccggcaacacctccaacgtcggcgacaacttcgtctcctggtaccgctacctccccggcaccgcccccaagctcctctcctacgaggacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16749 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggctccaacaccgtcaactggtaccagcagttccccggcaccgcccccaagctcctcatctacgagaacaaccgccgcccctccggcgtccccgcccgcttctccggctccaagtccggcacctccgccaccctcgccatcaccggcctccagaccggcgacgaggccgactactactgcgccacctgggactcctccctctccgccggcggcgtcttcggcaccggcaccaaggtcaccgtcctc

SEQ ID NO: 16750 - RNA, 318 nt, synthetic construct
  misc_feature 1..318: note = derived and/or modified sequence opt2 from anti-HIV-1_LightChain
  source 1..318: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcacc

SEQ ID NO: 16751 - RNA, 288 nt, synthetic construct
  misc_feature 1..288: note = derived and/or modified sequence opt2 from anti-HIV-1_LightChain
  source 1..288: mol_type = other RNA
ggcctctccccctccctctgctccggctcctcctccaacatcggcaacaactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16752 - RNA, 333 nt, synthetic construct
  misc_feature 1..333: note = derived and/or modified sequence opt2 from anti-HIV-1_LightChain
  source 1..333: mol_type = other RNA
cagttcgtcctcacccagcccccctccgtctccgccgcccccggccagcgcgtcaccgtctcctgctccggcaccacctccgacatcggcgagaactacgtctcctggtaccagaagttctccgaggccgcccccaagctcctcctctacgacaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16753 - RNA, 327 nt, synthetic construct
  misc_feature 1..327: note = derived and/or modified sequence opt2 from anti-HIV-1_LightChain
  source 1..327: mol_type = other RNA
cagtccgtcctcacccagcccccctccgtctccgccgcccccggccagaaggtcaccatctcctgctccggcggctcctccaacatcggcaactactacgtctcctggtacctccagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcacc

SEQ ID NO: 16754 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcaacatgtccaacatcggcgacaacgccgtctcctggtaccgccaggtccccgaggcccccccccagctcctcatcttcggcaacgacaagcgcccctccggcgtcaccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16755 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcaccggctcctcctccaacatcggcgccggctacgacgtccactggtacctccagctccccggcaccgccccccgcctcctcatctacgacaacgacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16756 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctccacctccaacatcggcaacaacttcgtctcctggtaccagcagctccccggcaccgcccccaagctcctcttctacgacaactacaagcgcccctccggcatccccgaccgcttctccggctccaagtccggcacctccgccaccctcgccatcaccggcctccagaccggcgacgaggccgactactactgcgccacctgggactcctccctctccgccggcggcgtcttcggcaccggcaccaaggtcaccgtcctc

SEQ ID NO: 16757 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcaccggcggctcctccaacatcggcgccggctacgacgtccactggtaccagcacctccccggcaccgccccccagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16758 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccctctccgccgcccccggccagcgcgtcaccgtctcctgctccggctcctcctccaacatcggcgacaactacgtctcctggtaccagcagctccccggcgccgccccccgcctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16759 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggccgctcctccaacatcggcaactacttcgtctcctggtaccagcagttccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16760 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggctccaacgccgtccactggttccgccagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcgccacctgggactcctccctctccgccggcggcgtcttcggcaccggcaccaaggtcaccgtcctc

SEQ ID NO: 16761 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcctccggccagaaggtcaccatctcctgctccggctcctcctccaacatcggcaacaactacgtctcctggtaccaccagctccccggcaccgcccccaagctcctcatctacgacaccaacaagcgcccctccggcatccccgaccgcttctccggctccacctccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16762 - RNA, 333 nt, synthetic construct
  misc_feature 1..333: note = derived and/or modified sequence opt2 from anti-HIV-1_LightChain
  source 1..333: mol_type = other RNA
cagcccgtcctcacccagcccccctccgtctccgccgcccccggccagaccgtcaccatctcctgctccggctccttctccaacatcgagaccaactacgtctcctggtaccagcagctccccggcaccgcccccaagctcctcatctacgacaacaacatgcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16763 - RNA, 336 nt, synthetic construct
  misc_feature 1..336: note = derived and/or modified sequence opt2 from anti-HIV-1_LightChain
  source 1..336: mol_type = other RNA
cagcccgtcctcacccagcccccctccgtctccggcgcccccggccagcgcgtcaccatctcctgcaccggctcctcctccaacatcggcgccggctacgacgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16764 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccctctccgccgcccccggccagcgcatcaccatctcctgctccggctcctcctccaacatcggcaacaactacgtctcctggtaccagcagttccccggcaccgcccccaagctcctcatctacgagaacaacaagcgcccctccggcatccccgaccgcttctccgcctccaagtccggcacctccgccaccctcggcatcaccggcctccagaccggcgacgaggccaactactactgcggcacctggcactcctccctctccgccggcggcgtcttcggcaccggcaccaaggtcaccgtcctc

SEQ ID NO: 16765 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgcttcggctcccgcttcaacgtcggcacctcctccgtctcctggtaccagcagctccccggcaccgcccccaagctcctcatcgacgccaacggcgagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16766 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccacccccggccagaaggtcaccatctcctgctccggctcccgctccaacatcggctcccactacgtctcctggtaccagcagttccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16767 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggctccaaccacgtctactggtaccagcagctccccggcaagacccccaagctcctcatctaccgcaacaaccagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16768 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctccgccaacatcggcaacaactacgtctcctggtaccagcagttccccggcaccggcccccgcctcatcatctacgagtccaacaagcgcccctccggcatctccgaccgcttctccggctcccagtccgacgccgccgccaccctcgacatcaccggcctccagaccggcgacgaggccgactactactgcggcacctgggactcctccctctccgccggcggcgtcttcggcaccggcacccgcgtcaccgtcctc

SEQ ID NO: 16769 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagaccgtcaccatctcctgcaccggcgacacctccaacatcggcgccgactaccgcgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16770 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccctctccgccgcccccggccagcgcgtcaccgtctcctgctccggctcctcctccaacatcggcaacaactacgtctcctggtaccagcagctccccggcgccgcccccaagctcctcatctacaacaacaacatccgcccctccggcatccccgagcgcttctccggctccaagtccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16771 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggcggcaactacgtctcctggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16772 - RNA, 333 nt, synthetic construct
  misc_feature 1..333: note = derived and/or modified sequence opt2 from anti-HIV-1_LightChain
  source 1..333: mol_type = other RNA
cagtccctcctcacccagcccccctccgtctccgccgcccccggccagaaggtcaccatctcctgctccggctcctcctccaacatcggcaacaacttcgtctcctggtaccagcagctccccggcaccgcccccaagctcctcatctacgagaacaacatgcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16773 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcacctcctccaacatcgccaactactacgtctcctggtaccgccagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16774 - RNA, 333 nt, synthetic construct
  misc_feature 1..333: note = derived and/or modified sequence opt2 from anti-HIV-1_LightChain
  source 1..333: mol_type = other RNA
cagcccgtcctcacccagcccccctccgtctccggcgcccccggccagcgcgtcaccatctcctgctccggctcctcctccaacatcggcaacaacgacgtctcctggtaccagcaggtccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16775 - RNA, 333 nt, synthetic construct
  misc_feature 1..333: note = derived and/or modified sequence opt2 from anti-HIV-1_LightChain
  source 1..333: mol_type = other RNA
cagctcgtcctcacccagcccccctccgtctccgccgcccccggccagcgcgtcaccatctcctgcttcggctcccgcttcaacgtcggcacctcctccgtctcctggtaccagcagctccccggcaccgcccccaagctcctcatcgacgccaacggcgagcgcccctccggcatccccgaccgcttcttcggctccgagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16776 - RNA, 333 nt, synthetic construct
  misc_feature 1..333: note = derived and/or modified sequence opt2 from anti-HIV-1_LightChain
  source 1..333: mol_type = other RNA
tcctacgagctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16777 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctccacctccaacatcggcacctactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16778 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccgcctccgtctccgcctcccccggccagtccatcgccatctcctgcaccggcacctcctccgacgtcggctcctacaactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16779 - RNA, 330 nt, synthetic construct
  misc_feature 1..330: note = derived and/or modified sequence opt2 from anti-HIV-1_LightChain
  source 1..330: mol_type = other RNA
cagtccgtcctcacccagcccccctccgtctccgccgcccccggccagcgcgtcaccatctcctgctccggcggctcctccaacatcggcaacaaccacgtctcctggtaccagcacctccccggccgcgccccccagctcctcatctacgacaccacccagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtc

SEQ ID NO: 16780 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggctccaagtacgtctgctggtaccagcagctccccggcaccgcccccaagctcctcatctaccgcaacaaccagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16781 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcgactcctccaccttcgagaacgactacgtctgctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16782 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacggcaactccaaccgcccctccggcgtccccgaccgcttctccggctccaagtccggcacctccgcctccctcgccatcaccggcctccaggccgaggacgaggccgactactactgcggcacctgggactcctccctctccgccggcggcgtcttcggcaccggcaccaaggtcaccgtcctc

SEQ ID NO: 16783 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaccgtcaccatctcctgctccggctcctcctccaacatcggctccaacaccgtcaactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16784 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatcttctgcaccggctcctcctccaacgtcggcggcggctacgacgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16785 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccctctcctgctccggctcctcctccaacatcggcaacaactccgtctcctggtaccagcagttccccggcaccgcccccaagctcctcatctacgactccgacaagcgcccctccggcatccccgaccgcttctccggctccaagtccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16786 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagaaggtcaccatctcctgctccggctcctcctcccagatcggctccaactccgtctactggtaccagcagctccccggcaccacccccaagctcctcatctacggcaacaaccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16787 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccgcctccgtctccggctcccccggccagtccatcaccatctcctgcaccggcaccggctccgacgtcggcggctacaaccacgtctcctggtaccagcagcaccccggcaaggcccccaagctcctcatctacgacaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16788 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgctccggctccggctccaacatcggcgaccgcttcgtctcctggtaccagcacctccccggcaccgtccccaagctcctcatctacgacaacgagcaccgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16789 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaagatcaccatctcctgctccggctcctcctccaacatcggcaagtccgtcgtctcctggtaccgccagttccccggcaccgcccccaagctcctcatctacgacacctacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16790 - RNA, 333 nt, synthetic construct
  misc_feature 1..333: note = derived and/or modified sequence opt2 from anti-HIV-1_LightChain
  source 1..333: mol_type = other RNA
cagcccgtcctcacccagcccccctccgcctccggcacccccggccagcgcgtcaccatctcctgctccggctcctcctccaacatcggcggcaacaccgtcaactggtaccagcagttccccggcgccgccccccgcctcctcatctacgaggacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16791 - RNA, 333 nt, synthetic construct
  misc_feature 1..333: note = derived and/or modified sequence opt2 from anti-HIV-1_LightChain
  source 1..333: mol_type = other RNA
aacttcatgctcacccagccccactccgtctccgagtcccccggcaagaccgtcaccatctcctgcacccgctcctccggctccgtcgcctccaactacgtccagtggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16792 - RNA, 333 nt, synthetic construct
  misc_feature 1..333: note = derived and/or modified sequence opt2 from anti-HIV-1_LightChain
  source 1..333: mol_type = other RNA
cagtccatgctcacccagcccccctccgtctccgccgcccccggccagcgcgtcaccgtctcctgctccggctcctcctccaacatcggctcccacttcgtctcctggtaccagcagctccccggcaccgcccccaagctcctcatctacgacaactccaaccgcccctccgccatccccgaccgcttctccggctccaagtccggcacctccgccaccctcggcatctccggcctccacaccggcgacgaggccgactactactgcgccacctgggacaactccctctccaccggcggcgtcttcggcaccggcaccaaggtcaccgtcctc

SEQ ID NO: 16793 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcatcatctcctgctccggcggctcctccaacatcggcaacaacttcgtctcctggtaccaccagctccccggcaccgcccccaagctcctcatctacgagaacaccaagcgcccctccaagatccccgcccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16794 - RNA, 315 nt, synthetic construct
  misc_feature 1..315: note = derived and/or modified sequence opt2 from anti-HIV-1_LightChain
  source 1..315: mol_type = other RNA
cagtccctcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggc

SEQ ID NO: 16795 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccgcctccgtctccggctcccccggccagtccatcaccatctcctgcaccggcacctcctccgacatcggctcctactccttcgtctcctggtaccagcagcaccccggcaaggcccccaagctcatcatctacgacgtcaacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16796 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcaccggcaactcctccaacatcggcgccggcttcgacgtccactggtaccgccacctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16797 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcggctcctccaacatcggcaactactacgtctcctggtacctccagctccccggcgccgcccccaagctcctcatctacgacaccgacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16798 - RNA, 333 nt, synthetic construct
  misc_feature 1..333: note = derived and/or modified sequence opt2 from anti-HIV-1_LightChain
  source 1..333: mol_type = other RNA
cagtccgtcctcacccgccccccctccgtctccgccgcccccggccagaaggtcaccatctcctgctccggccgctcctccaacatcggcaacaactacgtctcctggtaccagcagctccccggcgccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16799 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcaccatctccaacatcggcgccaacctcgtctcctggtaccgccagctccccggcaccgtccccaccgtcctcatccacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16800 - RNA, 327 nt, synthetic construct
  misc_feature 1..327: note = derived and/or modified sequence opt2 from anti-HIV-1_LightChain
  source 1..327: mol_type = other RNA
cagtccgtcctcacccagcccccctccgtctccgccgcccccggccagaaggtcaccatctcctgctccggctcctcctccaacatcggcaacaacttcgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcacc

SEQ ID NO: 16801 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagtccccctccgtctccgccgcccccggccagcgcgtcaccatctcctgctccggcggctcctccaacatcggctccaacgccgtctcctggtaccagcagctccccggcaccgcccccaagctcctcatctacggcgacaccatgcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16802 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcaggtcaccatctcctgctccggcaccacctccaacatcggcaccaactacgtctcctggtaccagcagatgccccccgccgcccccaagctcctcatctacgacaacaagaagcgcccctccgacatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16803 - RNA, 333 nt, synthetic construct
  misc_feature 1..333: note = derived and/or modified sequence opt2 from anti-HIV-1_LightChain
  source 1..333: mol_type = other RNA
cagtccgtcgtcacccagtccccctccgcctccggcacccccggccagcgcgtcatcatctcctgctccggctcctcctccaacatcggcaacatctacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16804 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccatgtccgccgcccccggccagaaggtcaccatctcctgctccggctccacctccatcatcggcaacaactacatctcctggtaccagcagctccccggcaccgcccccaagctcctcatctacgaggacaacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16805 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccccctccgcctccggctcccgcggccagtccgtcatcatctcctgcaccggcacctcctccgacgtcggcgtctacaacctcgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16806 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccatgtccgccgcccccggccagtccgtctccatctcctgctccggctcctccgacaacatcgagcgcaaccaggtcatctggctccgccaggtccccggcgccgcccccaccgtcctcatcatcttcaacaaccgccgcccctccggcgtccccgaccgcttctccggctcccgctccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16807 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaccgtcaccatctcctgctccggctccttctccaacatcgagaccaactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16808 - RNA, 333 nt, synthetic construct
  misc_feature 1..333: note = derived and/or modified sequence opt2 from anti-HIV-1_LightChain
  source 1..333: mol_type = other RNA
cagtccctcctcacccagcccccctccgtctccgccgcccccggccagaaggtcaccatctcctgctccggctcctcctccaacatcggctccaagtacgtctgctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16809 - RNA, 336 nt, synthetic construct
  misc_feature 1..336: note = derived and/or modified sequence opt2 from anti-HIV-1_LightChain
  source 1..336: mol_type = other RNA
cagtccgccctcacccagccccgctccgtctccggctcccccggccagtccgtcaccatctcctgcaccggcaccacctccgacgtcggcggctacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16810 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgcaccggcttcacctccaacatcggcctcaactacgtctcctggtaccagcaggtccccggcaccacccccaagctcgtcatcttcgagaacgaccgccgcttcctcggcatccccgaccgcttctccggctccaagtccggcgcctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16811 - RNA, 333 nt, synthetic construct
  misc_feature 1..333: note = derived and/or modified sequence opt2 from anti-HIV-1_LightChain
  source 1..333: mol_type = other RNA
cagtccgtcctcgcccagcccccctccgtctccgccgcccccggccagaaggtcaccatctcctgctccggccgcacctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16812 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccacctccgtctccgccgcccccggccgctgggtcaccgtctcctgctccggcacccgctccaacatcggcgaccactccgtctcctggttccagcacctccccggcgccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16813 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcgacaactacgtctcctggtaccagcagttccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16814 - RNA, 333 nt, synthetic construct
  misc_feature 1..333: note = derived and/or modified sequence opt2 from anti-HIV-1_LightChain
  source 1..333: mol_type = other RNA
caggccctcctcacccagcccccctccgtctccgccgcccccggccagaaggtcaccatctcctgctccggctcctcctccaacatcggcaacaactacgtctcctggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16815 - RNA, 333 nt, synthetic construct
  misc_feature 1..333: note = derived and/or modified sequence opt2 from anti-HIV-1_LightChain
  source 1..333: mol_type = other RNA
cagctcgtcctcacccagcccccctccgcctccggcacccccggccagcgcgtcaccatctcctgctccggctccacctccaacatcggcacctactacgtctactggtaccagctcctccccggcaccacccccaaggtcctcatctacgccaacgaccagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16816 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcacctcctccaacatcggcaacaacttcgtctcctggtaccagcgcctccccggcaccgcccccaagctcctcatcttcgagaacgacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16817 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagtccccctccgtctccgccacccccggccagcgcgtcaccatctcctgctccggcaacacctccaacatcggcaagaacttcgtctcctggtaccagcagttccccggcaccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16818 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccgcgaggtcatcatctcctgctccggctcctcctccaacatcggcaacaaccacgtctcctggtaccagcagctccccggcaccgcccccaaggtcctcatctacgagtccaacaagcgccactccggcatccccgaccgcttctccggctccaagtccggcacctccgccaccctcgccatcaccggcctccagaccggcgacgaggccgactactactgcggcgcctgggactcctccctctccgccggcggcgtcttcggcaccggcaccaaggtcaccgtcctc

SEQ ID NO: 16819 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggcgactccaccgtcaactggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16820 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctccacctccaacatcggcaacaactacgtctcctggtaccagcagctccccggcaccgcccccaagctcctcatctacgagaacaaccgccagccctccggcatccccgaccgcttctccggctccaagtccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16821 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggctccaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgtctactactgcggcacctgggactcctccctcaccgccggcggcgtcttcggctccggcaccaaggtcaccgtcctc

SEQ ID NO: 16822 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcatcggctcctcctccaacatcggcgccgactaccgcgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16823 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcatcaccgtctcctgcaccggcacctcctccaacatcggcgccccctacgacgtcaactggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16824 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagccccccgccatgtccgccgcccccggccagtccgtcaccatctcctgctccggctccgccttcaacatcgagcgccaccaggtcacctggctccgccacctccccggcaccgcccccacctccgtcatcatcatgaacaaccagcgcccctccggcgtccccgaccgcttctccggctcccgctccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16825 - RNA, 333 nt, synthetic construct
  misc_feature 1..333: note = derived and/or modified sequence opt2 from anti-HIV-1_LightChain
  source 1..333: mol_type = other RNA
cagtccgtcctcgcccagcccccctccgcctccggcacccccggccagcgcgtcaccatctcctgctccggctccgcctccaacatcggcttcaactccgtcacctggtaccagcagctccccggcaccgcccccaccgtcctcatctacggcaacgacctccgcccctccggcatccccgaccgcttctccggctccaagtccggcacctccgccaccctcggcatcaccggcctccagaccggcgacgagggcgactactactgcggcacctgggaccgctccctctccgccggcggcgtcttcggcaccggcaccaaggtcaccgtcctc

SEQ ID NO: 16826 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccgcctccgtctccggctcccccggcgagtccatcaccatctcctgcaccggcacccgctccgacatcggcaactacgcctacgtctcctggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16827 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccccccccggccagaaggtcaccatctcctgctccggcaccacctccaacatcggctccaactacgtcgcctggtaccagcagctccccggcaccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16828 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagtccccctccgtctccggcacccccggccagcgcgtcaccatcttctgctccggctccgactccgacatcggcatcaactccgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16829 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcaactcctccaacatcggcaacaactacgtctcctggtaccagcacctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16830 - RNA, 333 nt, synthetic construct
  misc_feature 1..333: note = derived and/or modified sequence opt2 from anti-HIV-1_LightChain
  source 1..333: mol_type = other RNA
cagtccctcctcacccagcccccctccgtctccgccgcccccggccagaaggtcaccatctcctgctccggcggcaactccgacatcggcaagaacttcgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16831 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcatcatctcctgctccggctcctcctccaacatcggcaagaactacgtcgcctggtaccagcagctccccggcaccgcccccaagctcctcgtctacgagaacaccaaccgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16832 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctccatgtccgacatcggcctcaaccccgtctcctggtaccgccagctccccgaggcccccccccacctcctcatcttcgacaacgacgagcgcccctccggcaccgccggccgcttctccgcctccaagtccggcacctccgccaccctcgacatcaccggcctccagaccggcgacgaggccgactactactgcggcacctgggactcctccctctccgccggcggcgtcttcggcaccggcaccaaggtcaccgtcctc

SEQ ID NO: 16833 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccgcctccgtctccggctcccccggccagtccatcaccatctcctgcaccggcacctcctccgacgtcggctcctacaacctcgtctcctggtaccagcagtaccccggccgcgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16834 - RNA, 333 nt, synthetic construct
  misc_feature 1..333: note = derived and/or modified sequence opt2 from anti-HIV-1_LightChain
  source 1..333: mol_type = other RNA
cagtccctcctcacccagcccccctccgtctccgcctcccccggccagaaggtcaccatctcctgctccggcacctcctccaacatcggcaacaactacgtctcctggtaccagcagttccccggcaccgcccccaagctcctcatctacgagaacaacaagcgctcctccggcatccccgaccgcttctccggctccaagtccgacacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16835 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcaccggccgccgctccaacatcggcgccggctacgacgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16836 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgctccggctcctcctccaacatcggcaacaacttcgtctcctggtaccagttcttccccggcaccgcccccaagctcgtcatctacgagaacgacaagcgcccctccggcacccccgaccgcttctccggctccaagtccggcacctccgccaccctcgccatcatcggcctccagaccggcgacgagggcgactactactgcggcacctgggacaactccctctccaccggcggcgtcttcggcaccggcaccaaggtcaccgtcctc

SEQ ID NO: 16837 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgctccggcggctcctccaacatcggcaacaaccacgtctcctggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16838 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggccgcgacttcgtctcctggtaccagcaggtccccggcaccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16839 - RNA, 336 nt, synthetic construct
  misc_feature 1..336: note = derived and/or modified sequence opt2 from anti-HIV-1_LightChain
  source 1..336: mol_type = other RNA
cagaccgtcgtcacccagcccccctccgtctccggcgcccccggccagaccgccaccatctcctgcaccggctcctcctccaacatcggcgccgactacgacgtccactggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16840 - RNA, 333 nt, synthetic construct
  misc_feature 1..333: note = derived and/or modified sequence opt2 from anti-HIV-1_LightChain
  source 1..333: mol_type = other RNA
aacttcatgctcacccagcccccctccgcctccggcacccccggccagcgcgtcaccatctcctgctccggctcctcctccaacatcggctccaactacgtctactggtaccagcagctccccggcaccacccccaagctcctcatctaccgcaacaaccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16841 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcccccaacatcggcaacaacttcctctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16842 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagtccccctccgtctccgccgcccccggccagaaggtcaccatctcctgctccggctcctcctccgacatcggcaacaacttcgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16843 - RNA, 333 nt, synthetic construct
  misc_feature 1..333: note = derived and/or modified sequence opt2 from anti-HIV-1_LightChain
  source 1..333: mol_type = other RNA
cagttcttcctcacccagcccccctccctctccgccacccccggccagcgcgtctccatctcctgctccggcggcggctccaacatcgccaacaacgacgtcttctggttccagcagttccccggcgccggcccccgcctcctcatctacgacaacctcaagcgccactacggcacccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16844 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctccggccccaacatcggctccaactccgtctcctggtaccagcacttccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16845 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagtccccctccgcctccggcacccccggccagcgcgtcaccatctcctgctccggctcctcctccaacatcggctccaacaccgtctcctggttccagcacctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16846 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccggcgcccccggccagaacgtcatcatctcctgctccggctcctcctccaacatcggcaagaactacgtcgcctggtaccagcagctccccggcaccgcccccaagatcgtcatctacgagaccaccaaccgcccctccggcatccccgcccgcttctccggctccaagtccggcacctccgccaccctcggcatcaccggcctccaggccggcgacgaggccgactactactgcggcacctgggactcctccctcaacgccggcggcgtcttcggcaccggcaccaaggtcaccgtcctc

SEQ ID NO: 16847 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcaacaacttcctctcctggtaccagcacctccccggcaccgccccccgcctcctcatctacgacaacgaccagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc
